US010260083B1

(12) United States Patent
Cavanagh et al.

(10) Patent No.: US 10,260,083 B1
(45) Date of Patent: Apr. 16, 2019

(54) RECOMBINANT K AND 812 BACTERIOPHAGES AND USES THEREOF

(71) Applicant: Charles Stark Draper Laboratory, Inc., Cambridge, MA (US)

(72) Inventors: Peter Cavanagh, Concord, MA (US); Helen Bartlett, Duxbury, MA (US); Kirsty A. McFarland, Boston, MA (US); Nicole E. Raustad, Charlestown, MA (US); Sarah Gruszka, Cambridge, MA (US); Jason Holder, Swampscott, MA (US)

(73) Assignee: THE CHARLES STARK DRAPER LABORATORY, INC., Cambridge, MA (US)

( * ) Notice: Subject to any disclaimer, the term of this patent is extended or adjusted under 35 U.S.C. 154(b) by 0 days.

(21) Appl. No.: 15/974,277

(22) Filed: May 8, 2018

(51) Int. Cl.
| | |
|---|---|
| *C12Q 1/66* | (2006.01) |
| *C12Q 1/04* | (2006.01) |
| *C12N 7/04* | (2006.01) |
| *C12N 7/02* | (2006.01) |
| *C12Q 1/28* | (2006.01) |
| *C07K 19/00* | (2006.01) |

(52) U.S. Cl.
CPC .............. *C12Q 1/04* (2013.01); *C07K 19/00* (2013.01); *C12N 7/02* (2013.01); *C12N 7/045* (2013.01); *C12Q 1/28* (2013.01); *C12Q 1/66* (2013.01); *C07K 2319/60* (2013.01); *C12N 2795/10131* (2013.01); *C12N 2795/10132* (2013.01); *C12N 2795/10143* (2013.01)

(58) Field of Classification Search
None
See application file for complete search history.

(56) References Cited

PUBLICATIONS

Eyer et al. Structural protein analysis of the polyvalent staphylococcal bacteriophage 812. Proteomics 2007, 7, 64-72. (Year: 2007).*

* cited by examiner

*Primary Examiner* — Michelle S Horning
(74) *Attorney, Agent, or Firm* — Christopher J. McKenna; Foley & Lardner LLP

(57) ABSTRACT

The present disclosure provides compositions including recombinant K or 812 bacteriophages, methods for making the same, and uses thereof. The recombinant K or 812 bacteriophages disclosed herein are useful for the identification and/or antibiotic susceptibility profiling of specific bacterial strains/species present in a sample.

24 Claims, 191 Drawing Sheets
Specification includes a Sequence Listing.

black= not detected, grey=detected by recombinant NanoLuc® phage

Figure 13

DNA fragment 4.1 (5'-3') (SEQ ID NO: 3)

TTGGCGGGTGTCGGGGCTGGCTTAAGGGTATACCATGTTATATTAATAAAGAAAACAACAGATGAAAGGAATTAAAAAATAT
GGCAATTGCAACGTATAATTCTCATGTTGAGTTAGCAAAATATCTAGTTAGTAAAGCTGATTCAGTTTACTTAACAATTGGAAA
GAGCACACCGTGGTCTAATGAAACAAACCCACCGCAACCTGATGAAAATGCAACAGTATTACAGGAGGTTATTGGATATAAAA
AAGCTACTAAAGTTACTTTAGTTAGACCTTCTAAATCACCTGAAGATGATAATAAGAATTTAATTTCTTATGGTAATAAATCGTG
GGTAGAAGTAACACCTGAAAATGCTAAAGCTGAAGGAGCTAAATG**GGTTTACTTAGAAAGTAGTATTGTTGGTGACGAACTA
CCT**

DNA fragment 4.2 (5'-3') (SEQ ID NO:4)

GGTTTACTTAGAAAGTAGTATTGTTGGTGACGAACTACCTCTTGGAACGTACAGACAGGTAGGATTTGTTATGGACTTAGTAG
CAAAAAGTGGTATTAGTAAATTTAACTTAGTACCTAGTGAAGTAGAATCAACTGGAACATTATTATTCTTTGATAATAAACAATT
CCAAAATAGAAGTGAGCAGACAACTGCTAAAGAAAGATTTATTGTAGAAGTTTAA*AGGAGGATGATTATTT*ATGGTATTCACA
TTAGAGGATTTCGTGGGAGATTGGCGACAGACGGCAGGTTATAACTTAGACCAGGTTTTAGAGCAAGGTGGTGTATCTTCTTT
GTTTCAGAACTTGGGAGTCAGTGTTACACCTATTCAGCGTATAGTCTTGAGTGGTGAGAACGGATTAAAGATTGATATCCATGT
CATTATTCCTTACGAAGGATTGTCAGGAGATCAAATGGGACAGATCGAAAAGATTTTCAAGGTAGTGTACCCAGTCGATGACC
ACCACTTCAAGGTAATATTGCACTATGGTACATTGGTAATCGACGGAGTAACACCTAACATGATAGACTATTTCGGAAGACCTT
ACGAGGGTATCGCGGTCTTCGATGGTAAGAAGATTACTGTCACGGGAACTTTGTGGAACGGCAACAAAATCATAGACGAGAG
ATTAATAAACCCTGACGGAAGTTTGTTGTTTCGAGTGACAATAAACGGAGTGACTGGTTGGAGATTGTGCGAACGTATATTAG
CTTAATAAAGAAAGGGAGATAATTCTAAATGGCAATTAATTTTAAAGGTTCACCTTATTTAGATAGATTTGACCCGTCTAAAGA
TAGAACAAAAGTATTATTTAATCCTGATAGACCTCTACAACAGGCAGAATTAAATGAAATGCAGTCTATAGACCAATATTATTT
AAAAAAATCTAGGTGATGCAATATTCAAAGACGGAGATAAACAATCAGGGCTTGGATTCACATTGTCTGAAGATAATGTATTGA
CAGTAAATCCTGGTTATGTATATATCAATGGTAAAATAAGATATTACGATAATGACGATTCAGTTAAAATAACTGGCGTAGGTA
AAGAAACTATTGGTATTAAATTAACAGAACGTATTGTTACACCTGATGAAGATGCTAGCCTATTAGACCAAACTAGTGGAGTAC
CAAGTTACTTCTCTAAAGGTGCAGATAGATTAGAAGAAAAGATGTCATTAACAGTTAATGACCCGACATCAGCAACTATTTATA
CTTTCATGGATGGGGATTTATATATTCAATCAACTAATGCTGAGATGGATAAAATCAACAAAGTATTAGCTGAACGTACTTATG
ATGAGTCAGGGGGATGTGCTGCAAGGCGATTAA

Figure 14

TTGGCGGGTGTCGGGGCTGGCTTAAGGGTATACCATGTTATATTAATAAAGAAAACAACAGATGAAAGGAATTAAAAAATAT
GGCAATTGCAACGTATAATTCTCATGTTGAGTTAGCAAAATATCTAGTTAGTAAAGCTGATTCAGTTTACTTAACAATTGGAAA
GAGCACACCGTGGTCTAATGAAACAAACCCACCGCAACCTGATGAAAATGCAACAGTATTACAGGAGGTTATTGGATATAAAA
AAGCTACTAAAGTTACTTTAGTTAGACCTTCTAAATCACCTGAAGATGATAATAAGAATTTAATTTCTTATGGTAATAAATCGTG
GGTAGAAGTAACACCTGAAAATGCTAAAGCTGAAGGAGCTAAATGGGTTTACTTAGAAAGTAGTATTGTTGGTGACGAACTA
CCTCTTGGAACGTACAGACAGGTAGGATTTGTTATGGACTTAGTAGCAAAAAGTGGTATTAGTAAATTTAACTTAGTACCTAGT
GAAGTAGAATCAACTGGAACATTATTATTCTTTGATAATAAACAATTCCAAAATAGAAGTGAGCAGACAACTGCTAAAGAAAG
ATTTATTGTAGAAGTTTAAAGGAGGATGATTATTTATGGTATTCACATTAGAGGATTTCGTGGGAGATTGGCGACAGACGGCA
GGTTATAACTTAGACCAGGTTTTAGAGCAAGGTGGTGTATCTTCTTTGTTTCAGAACTTGGGAGTCAGTGTTACACCTATTCAG
CGTATAGTCTTGAGTGGTGAGAACGGATTAAAGATTGATATCCATGTCATTATTCCTTACGAAGGATTGTCAGGAGATCAAAT
GGGACAGATCGAAAAGATTTTCAAGGTAGTGTACCCAGTCGATGACCACCACTTCAAGGTAATATTGCACTATGGTACATTGG
TAATCGACGGAGTAACACCTAACATGATAGACTATTTCGGAAGACCTTACGAGGGTATCGCGGTCTTCGATGGTAAGAAGATT
ACTGTCACGGGAACTTTGTGGAACGGCAACAAAATCATAGACGAGAGATTAATAAACCCTGACGGAAGTTTGTTGTTTCGAGT
GACAATAAACGGAGTGACTGGTTGGAGATTGTGCGAACGTATATTAGCTTAATAAAGAAAGGGAGATAATTCTAAATGGCAA
TTAATTTTAAAGGTTCACCTTATTTAGATAGATTTGACCCGTCTAAAGATAGAACAAAAGTATTATTTAATCCTGATAGACCTCT
ACAACAGGCAGAATTAAATGAAATGCAGTCTATAGACCAATATTATTTAAAAAATCTAGGTGATGCAATATTCAAAGACGGAG
ATAAACAATCAGGGCTTGGATTCACATTGTCTGAAGATAATGTATTGACAGTAAATCCTGGTTATGTATATATCAATGGTAAAA
TAAGATATTACGATAATGACGATTCAGTTAAAATAACTGGCGTAGGTAAAGAAACTATTGGTATTAAATTAACAGAACGTATTG
TTACACCTGATGAAGATGCTAGCCTATTAGACCAAACTAGTGGAGTACCAAGTTACTTCTCTAAAGGTGCAGATAGATTAGAA
GAAAAGATGTCATTAACAGTTAATGACCCGACATCAGCAACTATTTATACTTTCATGGATGGGGATTTATATATTCAATCAACTA
ATGCTGAGATGGATAAAATCAACAAAGTATTAGCTGAACGTACTTATGATGAGTCAGGGGGATGTGCTGCAAGGCGATTAA (SEQ ID NO: 5)

Figure 15

Non-recombinant Phage_812 (142096 bp) (SEQ ID NO: 2)

```
   1 ttatgtacta ctattactac tactaagtac ctttgttatg tactactatt actactacta
  61 agtacctttg ttatgtacta ctattactac tactaagtac ctttgttatg tactactatt
 121 actactacta agtacctttg ttatgtacta ctattactac tactaagtac ctgggaattc
 181 ttttaccict ctcactcagc ctattactta ttaccgactt ccctaactac ttattctata
 241 gttataatat tcatttatta tacaatactt aaactatagt attctactgt taatctatgc
 301 tgaagcggtc ttaatctatg gttattatat aataatctta tataatggta cattaatcta
 361 gtatattaca ttagaatcat tctaatctag gattttaatc tttagaccct aggaaaagtg
 421 gtactaaaat ataaaaccct ataggtatgg gattcttatt tttaaaatta ctaaaaagta
 481 ttaggttttc cctagggcaa agtttttaatg tacttaaaat agtaagtagc tacttatcat
 541 ttagggttct ataattgaga atattgagag ataatccgct tcaattgtaa ttaattgttg
 601 acaactatga agcgggtatg ctataattag gtatagtcaa atttaggaga tgaaatagat
 661 gattgatata tacttaggag aaggttataa taaagaatac ttgtctaaag cactcagatt
 721 aatcaatgac catgctccta gggagttaag ttatgatttt aataatgtag aagcggatgt
 781 taatattcac acaatgttat atgttaaacc tgaagataga tttatatata aggatatatc
 841 ctatgacttc ccgggtgatt taattatttg tatagttgat gatgatgcta ttgtatacca
 901 ccaaggtgag cagatttcag gtattagtat tttaagaata ctagaagaga tattttaagg
 961 aggataagta atcatgatag gaataacaat attaattacg ataatgagta tatcaactat
1021 ctctatgtat atttattttt tagtagactt gattcagtca atcagatata atagttttga
1081 taaggtaatt aacgtcataa catttgtact tatgacagtt ataatagcat caggtatttt
1141 agctatactt ggaatataga gctcatttaa gaagcggtta agtagttaga ggggatttgt
1201 cctaaaatag tataccgctt ctatatggaa ggctgagagg tcttagaatt gaaaggagag
1261 atataatgat tcatatattt ttaactgata gttatgataa taaagtttta aatactgtac
1321 tcagatatat taatactact agtgatagag agcttagtta cttaatgggt aaaggtgaag
1381 cggatgtatg tatagaaaag ggagtattta gtaatataga agatgttaaa attgactctg
1441 agtttattga tagaggtaac ttatgtatac ttataaatga agatggatta gtatgtagtt
1501 actacagagg agaatcatgt aatgttggtt cctttgtaaa ggagaggtta taatgataga
1561 aattaggtta actgaagatt ataatgactt gagtcttaag gcattactaa aacgtattaa
1621 aagggtagct cctagggaat taacttatgg tttagaagcg gatatggata ctacagatgt
1681 taatattgga gattcagttc cttctagagg tttatatgta gagtactcag aacgttttac
1741 tagggactta tggataattg tacaccettc aggttatgat gcttattatc aaggagagaa
1801 atatggtgga gagtctttag atgagattat acatgatatg ttttatgatt atgcagaccc
1861 ttttgactta gattattaga aaggagagat tataatgata gagatatacc ttagtgaaaa
1921 ttatgataag aatttactaa aagcagaatt aaaatggatt aaagagaccg cttcaagaga
1981 actaacttat gatattaata ggaaacctgg attggatgtt tatgttaatc cctataggtg
2041 tactaaagac gaagttgaag aatggagtac acttcctcca tttgaagatg atatacttgt
2101 atttatagcg gagacgtgga tacatgaata tcttaagggt gaatcaatag gtgtagatag
2161 tatggaagag tatgtaaagg agatgtaact aatgtttaag gtatattata cagtctacca
2221 tagaggtagt atgaaaacta ttaaggataa gctagataga agtagtttaa tatacttctt
2281 gtatgatact tggtataaag atattagtaa cgtattccct aatcactata ataagagtt
2341 tgggagtaag agtgatgata tagatataga taaacttatt gaagcggtta atgaggaagg
2401 tatattactt atcaatagag gtaattatgt tacaataaga gaatggtagg ataggataaa
2461 cttaggatag aaaataattt aggatgagtt acaataggat aggataggat aggggggttaa
2521 gttaggatgg atactttaac atacactatt attcataaag aatctgatag ggtaatagct
2581 agcggtttaa atgagacaga aactatgaac ttagttcaaa ggatgataaa tactaatcta
2641 gttactgata tatcattaga tgattatata cgcagaccac atggaaagat agatgtagtc
2701 aatttactag tagatattag aagacaaggc gtatttgatt tcaatcacat ttggcacgta
2761 ggataggagg gataggatga tagttatata tacagatgtt tctaaggatt atttaaaaga
2821 cgagttctta ccttggctta atgaaaggga tagatactta gaatactata aagatgaatt
2881 acctgaggat atagattcct cttatattgt atcagttgta tactgtaagg atatggaagg
2941 tctattagaa agaaaagaca ttgttcttga taatagttat aatgaacctg tagcttattt
3001 aggtgttcct gagttttttg gtaattatag taattatttc tattatagag gagaaagtat
3061 tagtaaacat gacctaggag aaattgttag gttaaaagct tggcaacgta tgggtgggga
```

```
3121 ttgactaagt agctctccct aatttcacta agtagctccc taggaattgc ctaagtagct
3181 cggtatgatt ttaccctaag tagctccctc tgttttctac tagtttattt taaccgcttc
3241 aggtgtctat atatatatag acggttggaa taatatcaga ccgcaaaaat aaatacacta
3301 ggatattatt cccagtgtat tatataattt ttttatagaa tatttataac attgtattca
3361 aattcattta cttcatgttg tgatttaatt aaattttttaa ttaatccgtt ttgtgtttta
3421 tactcttta ttagtttttc attttctata attaaattat taaattcttc ttttgttgtt
3481 tcctcatcta cataaaattt actttcatat atttcataat attttttatc tgttccgcca
3541 tctaaatcat ctgatatttg ataattttg aatataattt ctttgtttc taattcattt
3601 actaataatt gtgatttgc atattgtaat acatcttcat tgtcccacat tggaatatag
3661 tttattttca tttaaatcaa atcctttct tataattttt ttatataata tttgtagaag
3721 cggttggggt ttgtccctg cctactaca cttatatat tacagtatag ttattcagaa
3781 gtcaatactt ttgagtaact tttttttaaat tctttttct tctatataat agtagttttt
3841 agccctaaaa atgttttaa aagaatttgc atttcttat tgactttatt atcatatggt
3901 agtaatataa aggtacagca agggaacagc aacaagatat tagaattata taaaaaatt
3961 atttaatttg agatgattta aatggatgta aaagaaattg caaatactat aatggagttg
4021 tggcaaatgg acggctacag atgtgcagaa cctccattat atgaaagcac actaaaccac
4081 acacgcacac acacggcgtt aattgtttct attaatggaa actatgacac agtgcagatg
4141 ttccgcaaaa cgcctataat gagcatgaga gggcaaagcc aaccggctag catgttagtt
4201 aatgtgattg acgatgtaat tataatcgta tatgaaaatg tagtgtacgg agttcaaaac
4261 aaagaaataa aatttattga agaaattaa aaataggggt tgcaatcctc aagcatctat
4321 agtaatataa taggtgtagg ggatagcaac acacctcaaa aaactttta aaaaagttaa
4381 agaaaagtgt tgacaccta caagatacat gttattatta agataacaaa taagacaagc
4441 cacctagcaa ataacgaaat taaataaaaa aattatagaa taggatttga ttattatgac
4501 aaacaaaaat tacttatacg aagaaactca cacagtacaa gggcaagaca ttacggcttt
4561 cagaattcca aatgacgcaa acggcaaccc acgttatgta gtgaatttca gggacttagg
4621 tatcggatta tgggactatg acaacatcaa taaactttac ggatttaata aatatcgtgc
4681 caaatggttt ggcggtggtg tagtattcca aagctataat atagaagata cattaaattt
4741 tgcactagat aatgttaaag aaatagaagc ggttaagaat taaaaccgct tctgaattaa
4801 ataaaaaatt tatataaaaa ggatatgata atatgaaatt taaatagaaa aaaaataata
4861 gtgatataaa aactttatgg aatttagcaa aaaatggata tatgagctat caaactgtac
4921 acaatatatt taaaaatgaa tcagatgaat ttattatatt taacagtaaa caaacttata
4981 ataaatttat gaaattaaga tataatagaa gtgcaataca ataatataaa aaaaattata
5041 caattcccta ggattagatt tctagggatt tttatttatt ttaatttata taaaaaaatt
5101 atttaataaa taagttagtg taaaattgac tattgacaag gttgtatttt ttatggtata
5161 atgaagtgaa gaccttttt agtataaaaa aattattata taaaaaattt atattaaatg
5221 attttagaaa cgctctttcc cggaacctct tctcttatat agcggacacg taggctcctt
5281 accgcttct tactatactt atagtatact atagaaaaaa gaaaaggtca acccttttct
5341 ttaatctttt ttatattttt ttataattct tctaacggtt atttcactta tattatattc
5401 ctttgctaac ataggttgag tgtactttct aggcttgtat ttgcttgcta tggctttct
5461 ttcatcttct gttaatgcat aaccccctatt ataccttattg aaagtattgt ctttatggtg
5521 cctttattg tgttctgacg ggctaataca ttctaggtta tcaatacaat tattttgttt
5581 gttaccgtct atatggtgta catggtttga tttaataaaa tcattgccaa aatattcata
5641 tacaagtcta tgcaccatgt gttttttatt attgaccctt acggttaaat atccgtcacg
5701 gtcttgatgt acttactca acctatcatt tatttttacc ctacctaaat tagaaacata
5761 aaaattatat ttattaaagt attcttttt tataggtttc caaatttcat taatttatt
5821 ttcaaccatt tttttactcc tcctttttg gtatcactc cattatataa taattcggtc
5881 ttaatgtcaa tagataaatg taaaaaagtt tttaaatta atttcattaa atctattgac
5941 tttaatatca ttatagttta atataaaggt ataccaaatg aaagggattg aacaaaatga
6001 taaaattcaa atggaaaaac aaaacaatta aatcaactca aaaaacggat aacattctat
6061 tacttattat aggtggttta gttgcaacaa tcacacctaa acttgtaaac tggttttac
6121 tactacaaga taatataaat atttttttaa gataactatt gacaacctag aaacaacatg
6181 ttaatattaa gataacaaat aaatcaataa aggaaatgat aaaaatgaaa aaaatcacaa
6241 caacttaaa cttaatcggc atgaaaaata atgaaaggtt tacagaagag ttaaaaaact
6301 accgtcaaga tgttactttc ttgaaagcaa ataaaattgt aaaatattca aaataaggct
6361 tgacaactta aacactacat gttattatta aggtacaagg taagggaagc ggtcaaccgc
6421 ttccaaccta aataaaaaag tttaaaaaaa ctattgacag tcacttgaaa ccatgatatt
```

Figure 15 (contd.)

```
6481 attaagataa caaaaaacaa acagaaaagg aattgattat aatgaaattt atcaaaacta
6541 tcgaaaactt attaactaaa gcagaaaaca aagggcaagc aattttaaac ggtcgttatt
6601 atgacggata tagaaacggt gagcttgagg aaaaatatgc aatcgaaatt gatggcaaca
6661 aattaattat gcgtcattgg ggtacacaaa caattgagat tgacttaagc ataaatgaaa
6721 ttgtttcata ctatggtgaa agcaattcag accgtgacag tttaaacaca cttgtatatt
6781 gcttaggaat tgcgccaaac tttagatact taccaagcaa agacttgttc atttacgaaa
6841 attaattaaa taaagggctt gactttcaag ccctaccatg ttattattaa attgtaaggt
6901 aatcaagcac aacgacaaaa taaactgaaa aggaattgat acaaatgaaa ttaatcaata
6961 gagataatga aatcgtaatt agcatagcaa cacttgagag tgtaaaacaa gccctaattt
7021 gggagtacat cgaccactta gataataaca tcctagacaa agaaatacat gaccaggaag
7081 cggttgttat tacttcagac actttgcaat cactcaaatt tgcggacact atggaagaac
7141 tagaagaata tgtaaacgac atcggttgga aattagttta gaaaaggtat tgacatccta
7201 acatatagat ggtaatataa gagtatagaa aaaataaaaa aagaaaagga tttgattatt
7261 atgcaaaata caatacaagc attttacaa ggacaagaag caagcacagt taaggacgta
7321 gcaactcatg gagtacaaag cggagcaatt ggcaaattaa tctacacatc agacgtagta
7381 aacttctttg atagttacga gcaggacatt gaagcggtca tcactgaata cattgaagag
7441 gttacaggac aacaatatta tgacttattg aactatgagc ttatgagaga cctcgagaat
7501 tatgcaaatg tagaatttga agacgaagac gaatataata acattcaatt tgacctagca
7561 gaaaacattg cttctgatga ggttgaagga tttgaagaca tggacgaagc agaccgggcg
7621 gaagcaatct atgaggctat ggatgatgtt gaattagaac tacaagaaac tgacaaggtt
7681 caatatgtta atctagcggt tgagattgta gctcaaagaa tggcactata gaaagcacac
7741 agagaagctt aaccgcttct ctaatacaat taatcaggag atgttgaaga tgaatacaag
7801 acgggtaaac agagcgttaa acgaagcagt tagattatta gatgaacaaa tagcagatac
7861 tcaaaagact atgcaggagt tgaataaaca actagagaag caaataaagg ctaagcaaga
7921 gctaatggta ttagttgatg ttatgaatgg tgatgatgag taatgaacat tagagaggtt
7981 cacaatgtcg ttaagagtgc taagagcaaa ctcctgcagg agcaggctca cccaacggat
8041 aacctcatag agcagtacat caatgatgag ctacacagac gcacacagag aagcggaaca
8101 atacagatga acaataatac tacttcatat agtaatagcc catatggtag cttagaagag
8161 cttagagaag cttatgacct atcgtcatta tctactggtg agattaaaga actaatacaa
8221 acatttgttt aaattatttt atcaaaacgc tttacaatct tttagtttgt atgatataat
8281 gaacttaaca aattaaaaga aaaggaaatg atgaacatga caaacttaca agaaagaaaa
8341 caagaattga aaacgttact atttaacctta gcttagaga agaacaaagc aactgatgag
8401 acactgctta gcgtattaga gcaagcacat caagaggtag gaaatcaatt aagaaaagta
8461 agaaaagaaa tagaaatttt agtagaagaa aaagaaaggg aattttggaa tgatatcgaa
8521 tttaatggat tagactaaga gggaataaaa tccctctttt atttttatcc tattatataa
8581 ttttttata ttatacggggg gcaggggtaa aatgccactc aatgggggtg ggtctatata
8641 cccctatggt ctacccaggt acttattttt tggggaaaat tatgaaaata aatatttaaa
8701 agtcaacacc taaaatatag aacgtaagtc aacacccctat attaaaagtc aacaatttat
8761 agtacaaata gagaacctct aaatataaag tcaacatatc taaaataaga aagagggaaa
8821 ttaaatccct cctcttaggt attattaaca acctctaatt catgtatagt aatcatatcc
8881 atcccataga aatctcttgg gtctccttta atgaactctt gctctcctct atggtttgtt
8941 tcctctttat aaccttcttc tttaatacgt ttaattaagt tctccttatc tgtatatatc
9001 ttatcttctc taaaatggaa gttatcttca taaggttcac aattatcatg ttctacttgg
9061 tatagtttca ttagtcattt tcctcctctt cgtaagacca tgtaccatat tctgcattat
9121 agtgtgctgt atctgcgcct tcatcttcat attctacact ataccatgca tcctcctctg
9181 tttctgcatc tatatatctt accttctctg tagtaatagt acgtttact ttgtatctct
9241 tcaactgttt ttactccttt atattttcct ctagtatttg ttttaatgtc tgacagtctt
9301 ttggtctag agtatcccaa ctctctaaat tttgtaattg gtatagtaac tcatttacaa
9361 tttcatcgaa ggcttctgct tttatata cttcttctag ttctgtttct gctaattc
9421 tattccttt aatttgttct gctttagcta ctaagatatg ggcttattc atttcctcta
9481 taataaagtt tttatagttt tccattatta tttatccctc ctatttcta tccgttgttt
9541 tatctcttct ctattgcggt ggtgctcctt actcatttct ttacgttcct tatttgttaa
9601 ccttatccta taaacaaggt agttaatgta taagataccg gctgaccata gtagcaagaa
9661 tgatattaaa taagtccatg agatactaat ttctatcatt gtgagtcctc cttatattct
9721 ttatagctct taatggctat tttacaaata cctctatatta cagcaacaaa tactataaat
9781 gataatagtg ttataactgc tcttacatcc cctgtaaaag gtaatgattg aaagagcaaa
```

Figure 15 (contd.)

```
9841 tagttttcta aaacactaat agctgtaata gtagttagat ataatataga taataagtaa
9901 tcctttaatt ttagtttaac aaatggtttt ttgtgctcac ctgttcttac aataccataa
9961 agtattatga accacataac aggtactaac tgtataataa aatcattgtc tacattttaat
10021 gcatgtagag cgtaaataat aactgcagga atacctataa tgaatgctag aaatacataa
10081 aatataatta acattatagg aagggctaca agaaaaccta gaccttgttt tgaatactct
10141 aatgtgtttt tacctaggaa cttaaaaaat gttttattca tcttcttcct ccttggaatt
10201 actttctgta attgtaattt ctaacatatt attgtaataa tcattctttt gattgatatt
10261 atagttatca ttgtattcat taaagtctac ataaatatat tcatttgcgt cattttcata
10321 aataatatct atagctgtaa tatctgaata tgctgtaatc atttcataag cgttcgtatt
10381 atcaggataa gcaaaaccaa cttgaggtat ttccataggc ttatcaataa gaataccgaa
10441 ataagtacag tgacgtgttc gacttatact tgaagtccct ttatatgtac catagtaatc
10501 tataccttct gtaatacctg atatatggaa cctgcttacg tctttaggct ctaatcttac
10561 aacatcgcaa ttctctaata ctaaatcaat atatttgata ttcattttaa ctctcctttt
10621 atattaataa tttttttccat tctttatcaa cctttttaag ttctttttta ttatagtccc
10681 cgtcttttagt tactacagtg ttccattgga acttttgtaa taagctaaaa ttatttataa
10741 tccatatatt acttttacta taatacatat tgtcttcaaa tcttatatct tttctataa
10801 aatatttata tatttttatat cttcttttcat ctgcacctga tattttaata atttcattag
10861 tatttaattg agtggataac tggaagataa catctttttac tttcaatagg tctttaacat
10921 tacctctgcc tacatggtca ttatagcaat catatttaac tttttttcttt tgtttttctat
10981 cattaactac aatgaatata ttatatacga tataagcttt aaaatgggta taggtagtag
11041 gtgcttctga atcatcacat tctttttctta ggtctgtaca ttgtatttt aatgtaatat
11101 tatttgatat gttaactaca gtagagccct catgttttt attaagattt atcttatcca
11161 ttttataatt acctacttat tgtagataca atgtactcga acatcttcca ttactttgcc
11221 taatagattc tgacctttcc agttactttg ctctaatatt ttagggtcat ttgctttaag
11281 acctactccc catatttat cataaggtga agcttctaca aaatctttac gtacatctgt
11341 gtctaatatt ctttgcttta ggtgtgtagt cataaattta tctttaacta cttctaccat
11401 aatattatat cttactttat tccactgttc ttcattaaaa ttacgaactt tacgacctaa
11461 actttagca tggtttgggt tcttagcatt tagtatttca cctgctattt gaaagtcatt
11521 aaagtatctt gctttgcgcc acataaaggc ttgctctgag ttattaaatg ttcttccttg
11581 gtgtttaaac tttataggt agaaattaga ataaatatcc tcttacccc aaaacataat
11641 atattccctt gttctctca taatatttct cctttaattc catagtgatg gtaatacaat
11701 tttaaaatta tctaatattt tactttgtac ctgttcaagc tcatcatatt tatccatatc
11761 aaaatcatcc atttctttat gataatattt tattaagctt aaaatatgtt ttatcatatc
11821 tatttgtgtt cttctttgc cgtctacatc tacaaaagta tggtattcca tatccacatg
11881 attactactc tctataaatg catttaggtc agcgtatagc tgaataaaaa aggacatgtc
11941 ataattccaa tacttaggtt cattctacc tagttttttc ttcatttct tatattttt
12001 attcttttt atcccaaaaa cttcttttc aaagtcattc aatttaagac cttaaaata
12061 tttttctttc attcttaac ctccaattta ataaatggaa aatcaatgtt tctaaatact
12121 gcgccaacat cacacattaa catgtctcca ttaatttcta cttctccact gtctgtaggg
12181 gtgtgaccac atacataggt aaaaccatct tttctaggtt gaaagtctct tgaccatatt
12241 aattggtcaa ttgtttgttc ttctacaggt ttccaactaa ccccacctga atgagagaat
12301 atatacttgt cttctttata gtactttcta caattaacca taagtatttt aaattttcta
12361 tagtcgtctg attctttaag tttcttagt tcactttaa taaaatcata attatttctt
12421 agatttcct ctacactact atattttaaa gttactgtac tcacaccgta agagttaagt
12481 gtttctatac aatatcttga gagccattca atatcataga tacttaatcg gtctacgttt
12541 tccataatat tataaaactc atcatcatgg ttccctaaca gagttactac attatcatca
12601 ttagacatta aatcaaatat atagttaaca acatcttttg acctttacc tctatctaca
12661 taatctccta aaaatactat tgtttcttca ggttttcttt cattatttat tttatccata
12721 attgttaata atttttggta ttctccgtga atatcgggaa caacgtatat agccatctaa
12781 tctcctcctt attgtatata acatatcttac cataacttagt aaaaaaaagtc aataaaaaaa
12841 cacctattaa attaataggt gtttatcatt taatgttatt ttaaagtatc attaccatgt
12901 gctaattttt tatcatctat tgcatggtca ttataaatat attaaccctc tatatactgg
12961 tcttcactt tcagtgcatc tactatagaa gcattattag ttattgagct tgttctaggg
13021 taagtaaatt tttgaccgtc agataaaata atagtaacat caacttcaaa gttaacaggt
13081 agtctgtatc cataatcttc caaataatta ataaagttat taagagaaaa tggtttatac
13141 ttgccatcta aggtatagtc aatatattca tttaatgcat tagtaagttc tgattctgtt
```

Figure 15 (contd.)

```
13201 aactccattg tatcataatc tttttcgtta tagaatacta caacattagg ttgttctata
13261 ctagaatctc cgtctttata cttagatata aaaaatccaa tatttccttt atgctctaaa
13321 taatctgctt tcataatttt aagtacttct tctgctatag gttttgctaa tagtgttacc
13381 cattcacctt tttctgcgtc ataaacacta ggtagtacgt ttaccatcat ttaaatctcc
13441 tcttcttaat ttattggttt aaaccacaat ttactcttat cacttggttc tgtttcacta
13501 actacgaaag agttagaatc aatgtttaaa gtattaaaaa caatttcttg tttgtcttca
13561 ttactttttg ttgtaaattc gggaacatct gttaatatag actctttacc attaatagtc
13621 catgatattt taaaagacce ttggctatac actgtattcg gtgtcagttt ttcaattata
13681 attttagcgg atgcacctgt aatttttct gaagatttta ataatttacc tttggaatca
13741 tataagttta atgttctctc cacaaatttt atctccttta ctatatttg tacaattaat
13801 ataacaaaaa aacacctatt agtttaaata ggtgtccgac agagctcccg tacttagatt
13861 acggttaata atattttacg acaactatat gagaccctct gtcgttgaaa ctcttgtcac
13921 tgcgttattc cacaagatat tttagaaggt agcttgtgga agaagattgt tttttaaaggt
13981 acaattagcg tttttaagcc tattcgatac ccaggacact atgtccgtac taactattac
14041 gtcaataaag gttctacggt ctcaattacc tactctttat tgttaaaact aaaattaagc
14101 ttgagtgctc tagaagccaa aatcaattaa ttaactatag atacggaatg gaggggcact
14161 accatccgga gtctacggtc agatacaaag cctctgccgg gcaacatacg gtatctctcg
14221 tacatcaggt tgactagacc tttagagttt ttcactcctt ctcttataac cagtaactta
14281 agagaaatag gtttactta gtagatatga aacaataaat ccacatacaa tattaaatca
14341 tagtcaagtg attgcacata tgtctaacac ctataagttt tttgctagcc tggtatatgg
14401 actctgcagg attcgaacct acagtcaaac cgttatgagc ggttggcttt acctttaagc
14461 taagagtcct agaaatatcc tgagagagga ctcgaacctc aacgactagg tagctacatc
14521 tagccaatgc cattactcag gattgctagt aacgctaaat agaattataa cgttaccgta
14581 gaccttttct acgcttggta gataggtaaa atataatgat ttcaaagtac ccatatagtt
14641 aggctcttat tctcattata aggttaaaaa ggctaactgt gtttagcatt ataataagagg
14701 ctttagttaa ctactatact aataatatac cataaattat acttaatgtc aagttaattt
14761 atcaattgaa tctataattt ttgatgtgct acgtatatct gcttctttac tatgtttaag
14821 gagatatttt aatttcatta aaaaagaatt ttttttctttt tctataatat cttctttatc
14881 atcatattct gaaaaacataa tgaattctat acctatacta tttctattat gtgaaaacat
14941 atttatagaa aaaggtgaat caaaattttt atcatcttta ttaatactaa agtcttcagt
15001 aacctgtaag tcatttattt cagatatttc aaagtaacca ttaactcttt taagttcaat
15061 ataactattg tatctaaagt aacgttgttc ttctattaac ttctcttttg ttataaagg
15121 atattcattt atgaatatag gattacttgt tccatagtta tctctaatat attctgcatc
15181 ctctagggaa tcagtataac ctaaaatttc ataacttgtt gtatacactg tatcttcttc
15241 ccacaagtca tagtccattt cctctatttc ttcttctaat atataaattt ttttcatata
15301 ttactcccaa acccegataa gatttttaag cttagctata acctcttctt ctgtttgata
15361 agaaaatacc cctgtaatat gttcatagtt acctacaatt tcataatctt gtgtaccatg
15421 tttatctact aagtatgagt tattcataac atttaaacta tcttctgagt aactaaaatt
15481 tatgttatag tctactaaaa aattaataat atttttcatt tacataacct ctcctatcgg
15541 atattgtcct agcattcttg ttccattttc attataaaaa gtatattcta ctacaataat
15601 attcatcata tctacatata tagcttctat atacggtgta atattttcct cttcttgtat
15661 gtgtttacct atgatatcat ataataattc tgagtgtatt cgttatctc tcattataga
15721 cctccgtaag gaattctaca gttttgtctt tcaaagattt ttctactaat tccatagcat
15781 ctttatagtg tttgatatta gattcattag acttaagttt atctttttact tcttgaatta
15841 ggggctctac tttattaacc aaatctttt tcttttcaat acttacattg cttctctat
15901 tgtctaatac ttctttttggc atatatttaa ctttttgcaaa gtctttatag ctaacattta
15961 agttatctaa atcatctaat aaatcattat agtattctaa atgattatag aatgtataaa
16021 acttaacaag gtctttacca gttaattctc ctttttttag tatattatta atattaccga
16081 taacagaata tgctataggc ttaaaattag ctctaacata agttaaaaat ataaaatcat
16141 cataaaataa atctaaaaca gttttattga atctagtatt tttagcttgc tctaattgag
16201 cacataaatt aagaacatta tcaaacccac ttttagaac taaagagata aatctttcta
16261 ctgcatagta tcttgatact tctgtatgct tacttgcttt ttcattattc ctaaatatag
16321 tatctgataa aggttgaaca actaaactca tgtaatcttt atctgaatgc tcatctgatg
16381 ttccttgata agtacttcca aattctattg ttgataataa gaacttttct tctaagttca
16441 ttataacatc ctcctttat ttgttatttta aataataaca tatattgata ataatgtcaa
16501 tacttatata tcttcttctg tatcaacttc atcttgttta tacttaaagt gttcatagac
```

Figure 15 (contd.)

```
16561 tttaaatagt ataatcccta gtgttattaa tcctaaaata tatttcatag caatcctcct
16621 taataaccat gtttagttac ccaccctgct aaagcatcca tagctatatc atattcttct
16681 tcatttttaa ttcttataat tttctctatt tcttcctttg cttgcttaga actaataaaa
16741 tcaatatcag tatcctctag gttagttaat tctaagtttt ctctaataaa attcttttga
16801 cttggtgtta tagaattaac tcttacattt tcgtgattta gaaattggta gaagtccata
16861 ttactcatcc tttttaacgt attctgccat atctttaaa atacttagta catactctaa
16921 atctctatat tggtcatcta acgaacctat aatagcatat ggtgtcatat cccaggcatg
16981 tgcacagtca aaccctaata ctctcttacc ctcatagtca taatcatcgt aagtgatacc
17041 tctatgggca cgtctttcta aggagtcata ttcttttca ttgatatctg aaggtaaagt
17101 tatatatcca tttagatgac cagtttcagg gtgtctctta acagttagtt taactcctt
17161 ataataaata tcaagactta aatcttctcc tagaatattg ttttcttttt ctacttttc
17221 cataatgtat tgaggtgctt tttaaacat aattagtcat ctcctttta tttatatctt
17281 tactatacac tattttttat attttgtcaa caaaaaaagg ctactaatta aagtagccta
17341 aatattaatt atttagcgtt ataagaccaa cgccaataac cattttctg tgagaactca
17401 aagtgaaaac catccatagtc aaattcaata ttatagtctc catcttgaag tggttttgaa
17461 tttagtacag gactattact ctttgccaat tctgctagaa actcatgatt tactttttcc
17521 ataggvttta ttcctcctaa ttattcttac agtactaata tatcataggt ctttttctaa
17581 gtcatttta aaagtttcct cgtaagaact agcgtaagta acctcataac ccactacgtt
17641 agtatatcct acatataatg acttataatt agatttatc ttaatatctt ctgattgttc
17701 tagcttattt aagacttcac ctaaatcatc tgaagaatag tgttcattat ctattgttat
17761 tgtttacct tgggtataga tatcaatttc ttgtatcatc atttcatcct tttgattatt
17821 cattatttga ttataagttt ctaaatcatc aatgttatct gtatctgaac ctttactaa
17881 ccattctcct ctcttcttaa ggaggtcatc aaacttctca tgctctttaa ttatcttttc
17941 tacctcactt ggtattaaca cagccctagc atagtttata tgccacatag acatattatc
18001 aataagataa ttaaccattc ttataatctc tttttcattt gccatatacc aacctcctta
18061 tatctattac taatataaga gaaaagcaga cttattaaaa gtctgcttct gtacctaatt
18121 ctaatcttct attttcata tgaggaatca ttttttatc tcctgttaat agagataatt
18181 ctctagcttt ttctttagat aatgttagta gtccattata attatctact ttactattat
18241 attgtctgac taagtactct agttcatctt ctataccctgc tagttctcct gatttaactc
18301 caagtaactt tctatacatg tcataatctt cagaaagact ttctactttg ttttagata
18361 cagaatcata aactgcttgt aaattaccctt cttcaataag tttaaaatta tattcaccaa
18421 tgattaattc ttttcagaa gagtcaaggg taactaaacc acttgtatta cctgtaaagt
18481 cacctttata atctacaaca attccttcag ttattttatc tcctaattca atagttccat
18541 cttcattttc tttaaattta tgagcatcat aaacttctac tttatcacct aatctcaaat
18601 cttgagttaa gttatgttta ccaataattc tatccattac ttaacctctc ctttattaat
18661 agggtcttgt gttaagaaca tttctaagtt ctcttttgta ataggtaacc aaaaatattt
18721 actttccgga attgtaactg tatagaagtc ttcatcatta ttaactttga tgttaacatc
18781 tgtaaactca tcttgcatta accaatgggt tacagttaag ttatatgacc catcactaac
18841 atatcctaaa tcaatatcat gtctaaaagc caaatcttct aaatgttcta ataaatcgtt
18901 cttttcatta tgtttttctt cttctgtatt attttaatt gggttaatta attctgtaca
18961 aacaatatca tacaattcac catctgtaac ctcatagttc ttttcaatta atacatcttg
19021 tatttattg attgaatttg taactacttt cccatattct tcttctgtaa acttacattt
19081 atctaaatca acatctgtaa ttaattctgc aatccatta tttaaaattg atactgccat
19141 tgttcgagaa ataatactat cgtataccat atttatttaa tctccttatt taggtgaatg
19201 tggtcttcta atgaaaaatc aaaaggcgct acaccattc ttttattatt tgtttctttt
19261 ttaagtataa cataagttag tgaaaaagtc aagatagtta ctacaaccat tgataaaagt
19321 ttaatcaggt ttttcatagt tactctaact ccttaagttt attttttact ttctcttat
19381 cgtacttata atctttacta gagttttcat ttttttcttt ctcttcttca ttaagttctc
19441 tatactgagc ttctctacc tcttgttctt tattacgtt atcttcttct gcttttttgaa
19501 tttctacatt cttactacta ccatttacct ttttctaaa aagaaaccaa agtattaata
19561 aaatgatgag taaaataaca atgctcaata caacagccca aatattatta gccattacaa
19621 cctacctccg aatagttttt ttacagctct taagtttca gatgaatcgt tatttatatc
19681 aattcctacg ctagaatcaa aaattacagc attatcaagt atatgctctg ttaatttatt
19741 accataacta cttttactta ccacactacc ataaccatga ttagttaggt caaccatatc
19801 aggttcaact tctagtactc taaagatatt tctacgtaag aatgaaggat ttactaagta
19861 aaaggaagat ttaaaaacat ttaatctttg ataagaatgt tttatattaa caacaaaccc
```

Figure 15 (contd.)

```
19921 tgttaactta tcttcatatc ctgaatttga taacttacct aagtaaaggt ttatactata
19981 tccttttgtt tctaatgttt gaatagcact taacattata gcccctctgt aagcaagatt
20041 ttcagggtct tccatccaac taatactaga attataaaat acatcaataa cttcttctc
20101 tgctttaact cttgctgag acatcataga attaggtaac cctttatag cattaggtac
20161 gtgaggttga taccctccg gagctacgac aggttttctt ttactgact tatccattct
20221 aaataatgca tctgtcattt ttttaagttt aactaccata tcatatgact ctctatcacc
20281 cttaaccatt aagttatagg cttcttgaaa actatgagtc cctgtaaaat catagctacc
20341 tgtatctgat gaattatctc tacctgaaac tctattcttt tttaaagcag aaaagaaatc
20401 aggtagacca tcatatttaa ttacattaa ttctgagtta tctattaatc gtctacccat
20461 tgattttcct cctatctaa tcctaattta tccataattg tatcaaagtc cattgaatct
20521 tttgatgtac tatcagattt tctaggttcc tgcttaggct cttgttgcat acctaaaagc
20581 tttcttgttg cttctgtgta tctgttaccc tcaggtaaag agctaataaa ttgattaatc
20641 tcatcttcg gtacagattt aaagataata cttctacaa caaactcatc ttccattact
20701 ccatctaatt tactaccatt aataattgca cgcattgaga atacataagg taatcctttt
20761 tcatcattct catgtcttaa ttgttgtaca aagttaacta ggtcttcatt gctgataac
20821 tgatgttcca ccttagtatc atagtcaaat tcaacttgag caaagcggtc taatgtagct
20881 ccgtctaatt gttgtctacc tacataaata tggtctgctc ctgttcccat agtattacct
20941 gctgacacaa ctctgaaatc ttcatgagct gttacacgtc caatagggaa gtcaaagtat
21001 ttatttgcaa tagctgaatt aagaattaat agtacttcag gaatagatgc atccatttca
21061 tctaagaaga ataacccacc ttttgtaaat gctttataga attgggtttc atgaaactta
21121 ccatttgcat caataaatcc tgttaattta aattctgag taattgcatt actgaaataa
21181 aaatctaaat ctagagcttc tgctactgt tctaatacat ggttcttacc tgaacctgct
21241 ccacctttta aaaatactgg aatattttgg ttaactaact ttagtatatc ttggtatcta
21301 taatggaaga ttcctgagat atctttaatt gttttttcct tcttgttgta attcaattt
21361 aactggtaaa ttactaagtt gttcttctac atattcttca atttgttttt taacgtcagt
21421 aataataatt tctctactct cagttcctgc ttctcaaca attgcatcta caattgcttg
21481 ttcatacgga ttagagtttt tctctcctag tttgtctgcc aagtctttg ttgtttccat
21541 ttgttgttct accaatctct ctaatctttc aatagtatct tgctttgcca tatttatcat
21601 tctccttga tttgttatac atttattata ttacaagtat ttgtatttgt caacaacttt
21661 ctaaaactt ttttagttgt taataaaaaa aaatacctta cacctataac ttaacatagg
21721 gtaaggtaat tgtcaacact tttattaaaa atacattaat ttaaaaaaat catcaatatc
21781 tttagtttca tgtgtatcca tatcatacat aaacatacaa ttatatgtat gattattcat
21841 tatttctaac atgttatgca tagaagttgc attattgaat tcctctaaat caatagttac
21901 cgtaagttct tgaccttcat aaagtatgtt tgctatataa tatttcctaa cacctcca
21961 tgttccatga gaagttcat tatgattaag tacttctaca cctagtgaag gtaaatattc
22021 tgaaaagtaa tatttacaga aatatataaa attgtctgtt cttttagaca cgagtactat
22081 ctccgtactt tatattctt tctaatcgta cataatatgt tttaattttt tgtacttctt
22141 tatctactgc atccttctt cctaaccttg tagtatattt tacaatatta aatatcatag
22201 aatcaacaaa gccatcataa gaaaaatgtt cttctagaaa agaaataaca tccttactac
22261 ctttatagtg ttcaggtaaa tgtgcatcta cttgtatatt ataataatct tctaaaagac
22321 ctatactttc accaagacta gataaagcgt aacctaaatc atttgaatca ttagaccatt
22381 ctttagatac tgatagtgca tctctataa ttgttactt taattttatct aaataatctt
22441 ctacttgagc ttgtgttttc ataaattctt ttgcgttcat gtaataccct cctaaattat
22501 ataaaaaaaa acaccctgct tggctacaag caaggtgaaa aaggaaagat attatggaag
22561 tgtactatct aagtacacct cataaatataa cagtttttcct tgctagttat tacttatttt
22621 ttaaggtctt cttctttgac aaacactcca ttaataagct tacctttct gtcttttatc
22681 tcatcataag ccatatcaat acactcttca atatctatat ctaactgtaa acatagtact
22741 gttaatacta caaaaatatc cccaacacta tctcttgtta catggtcatt actttagca
22801 atacctgaag ctaattctcc tgcttcttct aataacttta acatttgacc ttcaggttta
22861 cctgtttgta aatttctatc ttttgcccat tgtttaataa gttctacttt ttccatatt
22921 ctatatctcc tttaatttct gtatctttga taattaggtt atcagagtca cttgttacat
22981 ttaaattatc ttcaactaat tcatgtagat tattagtaat atcttcttca tacctataac
23041 ctacacgaac ataagcttta actctgatat ctatattaac ataatctct tggaatttt
23101 ccattctaa cttcctttat tatatcatat tatgatacta ttgtcaatta atctgagtag
23161 tttcctttag caagttgata cttttgtgt aattcttcat ataattctct catacccttca
23221 tagtttctca tatcatcttc caagaaacta aggtaatcta ataatacttt tacatcctca
```

Figure 15 (contd.)

```
23281 ggttctaaag ttataactgg ttttaccatt aggcaacctc cttaaattct tctttattta
23341 ttttcttgat atcttttct aatgcttctt ttaattcatt aggtaattta taggcatcaa
23401 ttgattgttg ttgacctaat acataaccat tatctgtaat acgtatttcc actgtaaacc
23461 atgaattatc taaatcttct tctaatcttg ctaataatat taaacaacta tttttagaa
23521 ttctgttagc atacccacca acacaatgag ataacatttt accttcatct ttaagtttac
23581 ttacagtatc tgcaggaagg aattttactt ttctaccatc tttaattta taagttttat
23641 caattatttt ttctaattta ttatcatatt tagctttaag ttctgcatca tctaattgtt
23701 gttgtataga ttgtttctca tctgtaacta tatcatgttc tagttttagt gaaaatggtg
23761 ttaaactaac actctctaat gttctataac cttctcttat taatattgat aaatcatgta
23821 agtaatctaa gtaatagtta tctagtgcat atcctgttat acgttgtctg tcttgagcat
23881 ctacatctaa atagtgcgtc atcttttgt aattagcaaa agatatagat aatatttgat
23941 tcacaatagg tttaactttt aaagcatctg taacatctct tgaatctcta accattaaaa
24001 aggtatcgtc aaacaattgg tgtaaattaa cttcattgtg taaatgatta tagtgcttat
24061 agagaatatt agcaaatctt aagtaattac cttgctcaaa tttatttaaa gttagtaact
24121 ttttataagt ctgttttgta agattgaagg cttcatgaac ttccattta ggttttttag
24181 gtatatggaa tagtaatgca tttctttcaa ataacccaaa ttcttctaag ttattatttt
24241 tatcaatatt tttaacaata tctgttaaag ttattaagta attagaagtt gaatttctc
24301 ctataaaaat cctatattta tctcctctat aatttatatg accataaaca tctgtattat
24361 caggacacca actagaaaaa tcaaaattat ggtgctctaa tgtttgttct attatcttta
24421 ttataattcc tctagttaag ttaggttgtg catagttttt taaaataaca tttaataaaa
24481 cagataaagt taattcattc ttatattcac ttttactaat atcatcttta talaggttta
24541 aagttatttc ttattaaca agactatctg ttaagaaaac cttaactct cctgttttaa
24601 cgtcaaatga acttttattt tctaaaaccc atttgttacc catatatgt ttatctctaa
24661 tatgtttaac ttaagacca aaagatgaat agttttcagt acttggatgc atgtaccaaa
24721 cacggctata taattcatct gtcatagcac tatagtactc actagaacct ttttctatat
24781 cttcattcat aacaataata gatgactta taagaccata tttaccttgg tctagtacat
24841 ccataatatc attattaaa ctatctacta ctttttata ttcttctaat tgtctagatt
24901 cattcctcca taaatggtca ttacctcta gttctttaat ttttctca acataaccctt
24961 ttgattgtat acgtctctcta ctcttataac catatacagg aaaatcttt cttcttctc
25021 tattagattc aatatactct ttgtaacttc ttcctttatt atcatcaact acacccttcaa
25081 ctaatttttc aactgtttca taagggttac cttcaaagtt tgttacttct ttattaccac
25141 ataggggctaa aaataaatgt atttctgtgg ctgtatcaaa actaaatata ttatgaatat
25201 ctctaaaataa ttctttagaa cctaagttaa ttatattatt ttctttttc ttaagaaata
25261 catcttcttc tcctatatag atacatcctt tattaaccett aggtaaatta ataatttctt
25321 gttctgttaa tccttttttgt ttataagtta ttgccattta aaatcactcc ttatttgtta
25381 tgtactaatc ataccatagt aaataatatt tgtcaacaaa aaaagaagaa ctttttaaag
25441 tccttctaaa tgagtttcgt atataacttt ttgaatttta tttaatggtt ctaaatctaa
25501 attcataata agttttttat actttcttga atttttaaaa ttgatagtat ttggcatagc
25561 aagagcttca tcaacatctt tagtatagct tacaacatct gaatagatat ctacttcttt
25621 tacatataga ccttgagtta aactcctaaa tactacctca ttatgtgcta taacttcttc
25681 tttctttct atgctcattt ataaacctcc tggtctactc tacacaaaca agtacgtatt
25741 ctaaattagt taaagaaact gatttaatat tgtttaattc ttgtaattc ttaatttcca
25801 catcatagtt cttactata gtccataatg tctctcctgc tcttactttg tgataatatt
25861 tatttccctc tttgataagg tcattcaata ttacctaccc ccttgagtaa taattagctt
25921 gtagataaca tataagtata agaacaaagt ttacaaattc agtagctata atatgaacat
25981 aggtatgtgt taaaaccata cttacaatta atgaagctaa tcctaatcca ataataagaa
26041 atagaaatct atttgttcct tctgcactt tagtttata aaaggttgtt atctgagtta
26101 catacgcaag gataatagta atagttgcta cagttgtgt taaggctgta aagtcactta
26161 ataaaaatag taacagtgag aacacaataa taaaagggtat agagaaatag tcctttttc
26221 tatatgaagc tactaataag caaacaatac ctaaggttaa attaagacct acagatacta
26281 tttgaaatac tgaagcatca gttaataata agttgtaaaa acttataccct actgtagcta
26341 caattaaata ccaaaaatag ttactaactc ccttgacact ttctgcttta actaatgcta
26401 ctaaacctgg tatatatcct actgtaatta atatagcata taatatactt aagtaatgtg
26461 ataaattatc catcttgttc ccctaatttc tctaatctat taataacttc ttcccatgaa
26521 ataaatcctt ctccgtctgt tagttctaaa accataccat acacaaattg gttcgtacta
26581 aattcagctc tgtcagggtc attgtatggt ttaccatgtc cttgtctaat atccgagcag
```

Figure 15 (contd.)

```
26641 tagattaata cgggtttatt tacaatgttt tcaagtttat ctactattaa ttcttcttca
26701 gtatttaatg acgtttcaaa cttatttgta aaataattaa aatactcttc tccattatca
26761 tatatatggt taattgtttc ttctgcttga tgtttcatac ctaataaaat accgagttct
26821 gcaattgttc ctaatccttc attaaggata tcaaatacaa aaatatctga ttcttgcata
26881 gccttaaagt cattagttaa aatacgttct gctagcttag tttgttctgc attagcttta
26941 tcatttattg acttatcttt gtgagggcta taaggagtta ctcctacaat gccatctact
27001 tctttatgtt gtttatctct gtaatctacc atagcttcat ttaggatatg tccacccata
27061 taaattactt tgtctttaat tttattaccc atctatagta tctccttttt ctctaaaat
27121 ttctcttaaa atatgtggca ttttttttctt aatttgttta tctactattt tcagtatatt
27181 ttcttttttct tcttccataa tatcatcaac aaagtttga cctactgtt tcataattag
27241 accgaagttt tctaattcta aatcatcttc agataatcta tcttcttcta tagccctaaa
27301 aatcattttt tccattcttg ctcttgtaat ggcataatct gccactgact cgttcttttt
27361 tacttctgtt ttcattttt gacgactaaa ttctttaaac tcattagata ctaatttaaa
27421 gtagtcatca tattctgatt taccatctaa gtatttaatt actataccct cacccttatc
27481 aggtttaact gtcatgtcag atttcctac taattcttga atttcttcag gttttaaatc
27541 atttaagtag tgagatggtt tagatactag caaagttta actgtttta accctaaatg
27601 atgtgcaatt acattcatgt cttctactga taaataaact tcattttctt tatcataaac
27661 atcaaataca taaaaattgt tgtaaaattc ttctttgtac tgaatcttat gtttgactaa
27721 ccattcacca aaaataatgt attttttctaa ggctgatacg tacgtatttc ttacatttat
27781 attttcatgt acccaatcat aaaaaccatt taaagtttca ttctcatta atttttttct
27841 acgtgaaaaa catactaatt caccattttc tactgtgaag cttgcattac ttccatctaa
27901 tttttcttgt acaactagac ctctttcttt aaatttatct agtacaatac ctttatttt
27961 tactttagta tacgattca ttaattatcc tcctttgaat tatgtactat agaaaacaaa
28021 ataagactta cgcttgctaa aaatgctaat actactaaac caggtaaatt taaaactgtt
28081 gataagaata atgatattgc acttataaca taaactagac cgcttagaaa taaagttaat
28141 aatacaattg ttataagttt caccaaccaa ttgttattaa taaataccctt agctaaataa
28201 ttcataaaaa aatcctcctt agttattata gaataattat accataacta agggattg
28261 tcaacatatt attttaccat ttaaaattat ctgcatattg tgcaagctta gagcggaaat
28321 taactgtaaa attatgaaat actgctcctt cataattttt aaagtattcc atataatctc
28381 caaaacctga tttacttcg ttctttaaat ctattgttt aaaattaccct tctactatta
28441 cagtagaatt tttgtatga accctgtaa gaacttttt aagttcacta cgtttaaagt
28501 tctgtgcttc atttataatt atagtagcat ctcttagatt tccacctctt aggaatagat
28561 gggatatttg agatacccaa caatctccta gtttatcttc tttaacatta tcttccatca
28621 ttaacatttc agttattttgt tgttcaggat tcatattaag ttcaataagg gcatcatgta
28681 atcccatgaa ataagccatt tctttttctg tctgattacc tggtctgctt cctaaatctt
28741 ctgatactgg tgaaattata aatactagct ttctattttt attaagatag tctgcgtaag
28801 cacaggctac tgagcacatt gttttacctg taccggcttg actctcattc caaagtattt
28861 caacattatc attaaagaaa tcctcacaga aatctaactg ctcggttgta gctttttcaa
28921 ggaattcatt aaagactaga tgttctccca tgttgtatct tacattagga taatctttta
28981 acttaaagtc taactcttt agttgtattg ccatatttta aagttcccct atctataaat
29041 agttttactc tcttttaata tagtactaat ttccgatata ttctcctgtt gaagagcaat
29101 aattactaca ttcacattca gggtagttat cacaaacatc ttcatcttct acatcatcat
29161 aaccaatatc ataattatta taattaaaat ctacaataca attttcacta ttacctttag
29221 ataatcctgt ataaataata tcatccacag aatcccaatc gttatctgcc aagtaattta
29281 cactatctag tactgattca ttatcaggta aataaatact accgtctgaa aatttaatta
29341 aaatatcacc ttgaggtaag gtatcattaa ttaaatcaat ctctgtttct tcttcaatag
29401 tgaatacagt tccttctaat ctttccggtg tagtatgtgt taaatgtttt acagtatccc
29461 ctgatttcttc atagaatcct actgcattca tatctttatt atattttgca ataaatttac
29521 cattgtcact taccaaatat tgactagttg cattatagtc gtttgcgtca tctactgtca
29581 tgcaagggtt ataatctta acataataac taattttcct aacatctgct gtttgtactt
29641 tcttaccttc acctttaatt actgaattaa ttttcttcat aatatttct ccttttttata
29701 tatcaattga tttttttgca agattatcgg catagtcatt ccatttgtca tttgaatggc
29761 tctttactt tacaaagttt atatctatta ctttttggta ttctcgtatc atattaatat
29821 atgttttact tagaatattt cttgcagacc aagtacctc ataccaatgt attaaaccaa
29881 tataatctat ataaactatt gcctgattgt atcctagttt tatagcctct tcaatacccat
29941 aacaacaagc caatatttca cctgcaacat tattatactt tattaatcct ggtttgtcaa
```

Figure 15 (contd.)

```
30001 cactttact aatttccgat attatattc cttcttact taccaagaca gcacctgagc
30061 ctactttacc tttattatat gaggagctac cgtctgtgta tatatttaca ctatcctgca
30121 tacttataat cctccataaa ttgagggaat tcacaatctg aatagacttc tctgcaaaaa
30181 gatactgaga tatagttaaa atcaaaacat ttgaaacagt gttcttgaac ttctttta
30241 tctttagcaa tcacattaaa tttaaaacca tcagctatta ctgtaaatac tcctttttc
30301 ataaaacaaa tacctccact aattttattt taaattaata actaactcaa taaatgattt
30361 aatagtttta ttttaccttt catcaatatc tgaaaagaaa ttaattaaac tgtcatcctc
30421 atcaaataaa tcttcaacat catcaaattt atttaatatg tctgtaacac tgtaaccctc
30481 ttctgatata tactcatgta agtcttctcc atcttctgac agtgttgctt ctatttacc
30541 attttact tcaattaaat ataaagtatt taacacttta acagaatcta caactacact
30601 gtagttacta atagtaggat actctgtata aagtatttct acattagtat tcatataact
30661 atcaattaca gagttaactg tatctctttt tagctcagat acattatgtt ttcgtatagt
30721 aggaaattct tcatcatatt ctactaattc ttttctatct gtattcaata actgtctaa
30781 agaggacaac aatactattt tatattggtt atcaggaaga ctgtctgtaa tttccattat
30841 tgttaaaaac gtatcttcac ctagaacttt gtttatatct tgtaattcaa atgaatctac
30901 catttcaata gtatcatcta tatcatctgt agtcattaaa aaattaacta aattattatt
30961 ctccatcgtc ttcctccaat tctttaaata actcttttcc tggagtattt aacgcttct
31021 ctaaccgcat taaattagca cttcttggtt tcttttttcc atactcccaa taagatataa
31081 gagagtaatg aacacctatc tcagaagcta gacttcttaa cgtatgtcct ttttctactc
31141 taattttttg aaggtttaga ggtttacttt cctttttttc atccataatt atttctcctc
31201 tactttaaa aatttaaaat cctcagatgc ttttgcattt tttagtatat actcttgtga
31261 tttatttctt gcctctgcct tactttttagc atataactct atatgaaata catgaggttt
31321 ttttaaagac ggtgactcgt atctccaata aactttaaaa agtagtgttt cttttttaa
31381 aacattaatt cgaaaccatc tttaaattt attcattcat tatcctcctc tatttatttg
31441 ttaaactaat tatagcatag ttaacttatg aagtcaacta taatatacaa aaaaagacta
31501 agaaattaat cttagtctta atatattaat aactattatg tgcgttgtgg tatgcaagag
31561 ctcctgatgt tgaaccgtaa cggtcaatca tatattgttt tgcaccttta gtttgttctg
31621 ctatagaacc accactccat gatttaccta atccttggaa taatccttga gctcctgatg
31681 atgcattaac agcattaggg ttcattgtag attcacgcat agcaatttca atcattgcct
31741 cgtctccacc tgcttgtcta atctgttctg ctacagagcc tcctgtagaa ctagttgatt
31801 gtgtaggttg tttagtttcc ttttgaactg gtgctgatgt tgtttgtact tctttttag
31861 tatcttgttt attttgagta tcaaattgtg cttgttgttg gtctactttt tgttcaggtg
31921 tttgttcttc tcctgctaat ctagatactg tattatctac ttgagttgag cctgaatggt
31981 attcataacc aaagttacca ttataattat agaaatgata agtaaattca ccatcactaa
32041 aagagaaatc ataattacct gcttgaattg gttttgtatt tacttctgct gaatttgatt
32101 tagcttgttc tgctaactta ttataatcaa tttcgtctgc actagcttca tttgtagcaa
32161 tacctccaaa agtaatagct gtacctaatg ctaatgttgc aaaaattgtt ttcttcataa
32221 atttaaaact ccttaaataa ttttttagaa ttgtttattt gtaaaccgac ataagtaatc
32281 ataacatata tctttaaata acgcaagtat aatatagcac taattagtgt aatattatta
32341 aggttttatt acaaacatta cagttatcag ataattaaat acaaaaaaag agaggtaatt
32401 atatttacca ctctccagtt tcattatatt tatttattac attatctctt aattctatag
32461 cctcttctaa agatttgca ctaaaatatt taactttatt ttttcttaca atttgtatat
32521 tatatacatt atttgatttt ttgtatatat tatgtgtact tttcttctt atattagttg
32581 agttttcaga cctagtagac cacttaacat taccaggttc ataattacca tcattattta
32641 ttctatctat ttgataattt tcattcggag ggtctcccat atagtcgtag aattttttaa
32701 aatcattctt ccattcttca catattctca taccccttcc tccatagttt ttataatta
32761 tagcgttaac atcgtaacaa cgctgtttca tacctaacca tctttggtac attgggttac
32821 tggataatcc atgggtagta ttcctttctc tcattaactc actatgaatt ttattactct
32881 cacacccaca agatttatt ttaccttgcc ttaaagtgga gcttctaact attattactt
32941 ctccgcattc acataaacat tcatacattt tacatcttga tttatccctc ttactagact
33001 cttttataac tttagttta ttaatagttt ctccaatcat aatatctcct cctataataa
33061 aactatagca taaaaaacca cctatgtcaa taggtggtta aacatatat ttatttaagt
33121 ttgtaataac actatctgaa cctatactaa taggttgttt tccattccat ttttcaatta
33181 attgttgttg taaaacttcc tctgttaagg attcactct aatgtcattg gctttctttt
33241 cacctttgc ttcaatttct ttcttttag cgttttcttc tgctatttgc ttatcaactt
33301 tagtgcgctc tagttcttgg tttgctttta ctctctcatc aattgctttt tgagtattt
```

Figure 15 (contd.)

```
33361 tatctgcagt tgggcttgat aatgcaatat catcaataat aaaaccttgc ttttctaaat
33421 tatcattaag tttatttaaa gtatcttgtt taatttctcc tgttttaca ccaaaagcat
33481 caattacaga gtacttagaa attgcttgtc taacattatc ttgtactcta gaacgaagat
33541 acccttttc aagttcttct atgtcagcac ttccgaatct attaaaaagg tttactgcct
33601 tagttgcatc tactttataa gatacatcaa tgtctaattt aatattttta ccatctgaag
33661 ttgctacatt taaatcttta tatttatgtg tttgtgtttt agttggggtat ttatttacct
33721 tatcaaaagg tgctgttaaa tgccaacccg gtgatttagt atcttccta acaccattta
33781 ctgagtatac aactccaaca tgaccttgtg gaatcttagt aatacacatt aataaaataa
33841 taaaccctat aattgctaaa aaccctaata ctcctgaaat aactactgac ttctcatta
33901 catttctcct ttttctattt ctttattaa gctatttaaa gcttttcct cttggtctat
33961 ttcttgttta tcggctctag ttacaattga ttgtctacgg tcattaaga attgtttt
34021 atactttaca tattgttcta aaccgtattc atctaatgta ccttgcctaa ctaattccct
34081 gtattgtttt cttatgttac tcttcttctc tttcattgaa agaaaatcaa ataaataact
34141 tataccaaaa cctacaagga ctagaaaaac aataaaaata gcaaatatg ttaaaagtag
34201 tgccatgtaa ttcctccttt atttgattac atatataact atacactatg tatttaattt
34261 tgtcaacact tttttgcaaa aaaaatagac ggatttaaa tccgtctaaa tttatattct
34321 atttgaatac tccccaggca acgccaggta tttgattagg tggaacacct tgacaagttc
34381 taacagggca atatactctg ttaccgttgt aagcattata acctatccaa atgtgacctg
34441 cttggataca aacttcgtca tatacaattg tagccccctgc cggtaagtta ccgcctactg
34501 gagcatttaa gaatggagaa cctattctag ttactatagg ttggttacca ttgacaaatg
34561 ttgcattttc cggtttatac caagttccgt actggttctt tttccaagaa cctgtaactg
34621 gtctagttgc cggtgtactt gcgctacttg ttttaccatc tttaactact gtagaacttg
34681 aagttccttt atccatgtag tttttaattt gttaatgaa ataatctttt aatttattca
34741 ttattgcttg tgatggtctt ccttgtgtta ctggattaaa tcctgtatga agaaccatag
34801 aacggtgagg acaggcagtt ggtacaaatt ccatatgcaa tcttacagtt ttacggttag
34861 gagtaagacc ccattcttta aatttctctg ctgtaaattg gaatactgct tgttcatttt
34921 taaggaattg agcatcacta gcactcattg attgacagac ttcaatacct gcaaatctaa
34981 agttacctga gtttgctcct gttccatccg attattcaat aaaagacgta actcctttac
35041 cggttctctt atgaactcct tatagtttcc tataagacta gactatatct tcaccctaat
35101 tttgttaggg gttctccatt tcgattaag ggattctcac ccactccatt aacttgagcc
35161 ctactcctat tgacgattta ttttttattgg cactcgtccg agggatagtc gttgaaccttt
35221 aatattgttt ccaaatgtat ccgtaggctg tttttctctc tcctttgata catcttccta
35281 tattaccact tcttttatta gaaataccta agaactctaa agcctctga gctgtgtaaa
35341 agacattcaa taaattacct tctaagtcat actgagctat attataattt atttcattt
35401 ttaatcctgt ctttattgca tgttctctgt tctcggaatt agaaacccat tctaaatttc
35461 ctacactatt atcattta ccatttaaat ggttaacttg ttctttatta tcaggattag
35521 gtataaaagc catagcaact aaacgatgta ttttaggtga atggtatcgt aaccttacaa
35581 acaagtaacc cttgttatt ttttgaagtt ttaacttttt aggctcttta ccttatagag
35641 atattacttc tccttatca gtaatagtgt aatttcata tattctaat ccaggtattt
35701 catttaattt cttttccata ataacatctc ctttacttaa gtatatagga aagttattat
35761 gttgtcaagt agttttttaa aacaatattc ttggatgctg attagcatag cttgatagcc
35821 ttagcctccc agtcaattaa aagaactttc attatacatt actgtataac agggcaattt
35881 atttacccgt gtgccaagca atttgattct tagcatctat tgcttcccat acataaccttt
35941 cagagccgta gtaatgagca ataccattag cgtatctagc ataacctgca ttagctaatg
36001 aattctcgta ttgttgtcct gaagaacgac ctgcatcgtt gtgtattacc attccttcag
36061 gtttttacc acgtttatcc attgtatagt taatgtgatt cttagaaact tttagtgttg
36121 ctttctttt aggtgcaggc gtttacttg cgcttttctt agctgtttct ttttaacag
36181 tagttcctgc ttttacaggt atttcaatga agtgagttaa tccgtaataa ttatctacac
36241 gtttgtagg tttttatta gcataaccat tccagttttg ctctaaaata gtaaatgtag
36301 aagtattacc tccatcatat acaataccta tgtgaccccca ctgttcataa ctaccggatg
36361 taaataccgc aatccaacct ttttaggta cagtagaagg ttattttca tgtatttaa
36421 atccagtacc ataactctgt ttaatttggt cttagcatt accccaagtt ctaactttat
36481 tatctgttaa ccataaaaca tagtctgtaa taaggtcttg acactgagcg tgatagtaac
36541 catctgcatc aatggctcct gcttccatta caccaaatga tgggtcataa cttgtagctt
36601 ttttaactct gtaagggcta tctactgttc cttttgcata agcatctaaa cgtttattta
36661 tttctgcttg agtcttagcc attacttaac ttcctcctct gcaaatactt taccatgttc
```

Figure 15 (contd.)

```
36721 ctcggtatct tcttcatctt gagaaggtgc tgaaccacca tcaatttcat cttcaatagc
36781 aggtacttca tcactatcat ctgtgtcagg ttctgcattg tttctgtagc tgtctatctc
36841 aaaagtacta gtgttatttg catttgcttg ccattgaacg aattcattag ggtcttact
36901 atcacgaggt ttaagatagt ctgtttgaac aatatcacta tctttaagac cttagtatt
36961 attatcaaca ataataccta aacctgctaa tagtgttagt atagaaccta caatatttac
37021 accttgctca atttgagctg agtagtctaa accgaaagca cctataattt ggttagcaaa
37081 taatgctact gctgatataa ttgctaccca aaatgttttg ctcttagttc ttgtgctaag
37141 gtttattcct ccaacaactt taggttgttt agtttcatta gccattaaaa aaccgaccttt
37201 tctattatat ttatttctaa caataatata acagtaggtc ggtcatgttt atctatatta
37261 atttaacact tactcattaa tttggtttag ttttttgata acttcagaca tttgtttgtt
37321 atctaaatct tctaatttag tttcaggaag tagctctaac ttatcccaaa cttcttcttt
37381 attagatact ttattattaa taattgcctt accaactaaa ctttccgtat aatataattg
37441 ttttgctgat gccatttgta tctctccttt taaatatgta aagtatatag ctagtatcgt
37501 atcctaggaa caaacacttg cgctatatac tcaatgaaat cctaccctca ttcgaggaca
37561 cagcaaaccg gttcgtcaac cgcacatatg aattctcaga tttcatttat gtaaaacaca
37621 ccctcttttga tttgcacaaa gactaagggt tttggagacc cttgtactac taattatact
37681 aagggtgttt attatggttt ctattggatt tgaaccaatg acacctagag cttcaatcta
37741 gtgctctacc atctgagcta agaaaccttta aaacgaccca tacgagactc gaactcgtac
37801 tctctgccgt gacagggcag tgtgttaacc agttacacca atgagccaaa attataatgc
37861 tataccctaa ccttacctta atgtatagca ggtttttata taagctcgaa gcaacgatta
37921 ttaccactca taacaactat atattaagtg aaaggaggtg aaatgaacaa aacgtggtaa
37981 ttggtactta tataggaaat atgtataatc tacaaggagt aagttattgg ttcataaagg
38041 agtgtgaaca ataatacat gaaagagtga aagtttactc cctgtagatt cttttttaa
38101 ttatcaatca aaggaggaaa ctgataattg ttaataataa actataaaga ggaaaatatt
38161 tatagtcaca ttctgatata atgcaactaa atatccaagc ataacccgtc tcacgaggaa
38221 cctaccatata agacctgtta ttaagtgaat cactacgatt gactctatta aggagctacc
38281 ttaagtccat ctcacgcaat ttaaaaggga cttacaaacc gtaaaacggt aataagttta
38341 ttaaataatg tgatattaac atattagtta ataactttca catggtcgaa gaaaagtaaa
38401 tttatttgat taccaaatta tttttatcaa atatagctct tttgaacctg tagatttatg
38461 ctacttatac tgataaccte tattatctaa cacattictg tgctccaact acagttagtc
38521 gttacagcgt atctttctag gattccgcta agaccctaaa aagaaattaa acccctagccg
38581 ttatcatact ctacagacct tataagtaag taccaagtat accaatcgta tttaacaata
38641 ctaatgacga cccatcctac cgatatatct ccgataggtt ttgattcgtt tgattatctt
38701 gtaccttatg actaccaaat cattattcag tcactatgct cagatatta gtgtattat
38761 ttatatatta attataacat aattttatt acttgtcaag ttaatttcaa aaaaattata
38821 gaagtaggga cgtttaccta cttctattta atttacacaa ggatgataac attgttattg
38881 ttttatactg gaaaacaatg taataaaaac agtgatgtgt aaggtattg tttattgtt
38941 aattatatta tagcatatac tgataccttt gtcaagttaa tttaatactt tttttaaaac
39001 attagttatc ttttgttagt tcctcctgaa tagcatccca tcttctttct gcttcactac
39061 gattatcttc tatatgtttt gtagttttac aacatttgat acaatatata tctttgatat
39121 gaccttcttc tcttttattt gctctttttc ttggtactt gaatacattt ccacattctt
39181 tacatattaa acttgagtaa aacatttttt gtcttttcat aattaatcaa ttccttttct
39241 cttttattg ataatttaac tatatactat attgataaat aagtcaacag ttttctaaaa
39301 ataatttaaa ttattttgaa gaatactta atatcaaggg ttacaagaga aaaagtacgt
39361 atttagaaaa taaggagtac tcctattata tataattata ttctgatata gagtaataaa
39421 taatattaaa tataataatta taattaataa ggttgggaaa attgatataa acataactga
39481 tactgcttat agatactcag tataaaagta aaatcccctta gtatcagtac ttacaggcaa
39541 aaaagtacgt atttagaaaa taaggagctc tcctattata gttatatata tttattacta
39601 ttattaatta ctatttaaat atataattat aattaacaat gttagaaagt caacaatagt
39661 ataataaaa aagtgacctac ttaaagtcac tcaataatta gaatactatt ttaaaagatt
39721 ctattctgtt tggattaata tacttgag gtgaagttat agcactttca gtatatactt
39781 ttatagaggt ttcatccatt cctcttaaca tataatctat atcttgccta ttgtaactct
39841 ttcatcagt agatactaaa aagtatttag ctccacttga cattgtatt tcaatatgtt
39901 ttgacatcta caatctctcc tatgcaaatt tgttaaagac aaaggataat atagctccta
39961 gaacaagtaa aagaaccttc tcagttgtat cctttttctt agtatcctta gttttgtac
40021 ttcagcaag ttctgaaatc tttcatcaa gtctttctaa ttggacgtaa attgctgatt
```

Figure 15 (contd.)

```
40081 gttttcact attgacagct acatctttat ctatactaac tatcattttt cttagttcag
40141 ctacctcaac ttctaaatct ttgaaagttc ctctatctat ataattacct tcttgtatct
40201 tagacttaat agtttctact tgagaaacaa ggttgtttat ctccttatcc aactagaatc
40261 acctctaagg tctaaccgtt tcagattcag aatggatatc ataattttct aagaaatcat
40321 tgataatctc catataatta tccgtaacga cttttccgta agatgttttt gtatcaattt
40381 caaacctaag cttaccaaaa ctttggaggt ctaattcttt tattacaata ttagggtcat
40441 cagaaggaag gtaataatag tcgaagtata taattgagcc atttattaat actctgtcta
40501 ttctatagac gtgctgtctc ttttaaaatg ggctagtgca tctttaaact
40561 ctaacttaag gatatcctta tatttagtca aagtggtaac ctccttacta ttaattttta
40621 aatttactta ttttgtggta taatagttat gataaaggca gttattataa ttatattaag
40681 aataatgata ataattattt tttctgagaa aataagccaa atactaaaaa cagataaagc
40741 atagatagct gatagatata ctatattaag agttacctta cttttatctt ttctatagat
40801 agaataacct aaagacgttg taacaccact aagtataaaa taatagaaac aaaaaagagg
40861 tatagacaga aaaaagata cgataatcat tgttaaacac ctatttcttt ttgacctatt
40921 atttctagaa cttttagatt acaccactaa tataacatta aaagccagtc ataaaagtca
40981 attgttagat taataatata ataaaaaaag acaataggag gttaaagtgg ttgaataata
41041 acatagctat attcatattc aaaacactgg ttatcattat attcttacta ctaattttgt
41101 ctgttattaa ttccttgtcc cttatttact caataagacc gagtgtagtt atgacatact
41161 ttatctttgg tggtattgtt tctaatgtcg cacttactgt aacagataag ttcttactga
41221 agaaagaaga cccctacct gaatatgttc ttaaaaaagt agagataaat gataaagaaa
41281 taagaataat caagaaaata atagaaagta attatggtat aacagcagaa gagataaaag
41341 ttagggctaa agcacaaaga agagtagagg aagatagtaa aaaggaagat tacaatgaaa
41401 acaaagaaag aaattaaaga acaaaggaaa gaacttaagg atggtgctac atctgtttct
41461 ttagtaaaaa agggagataa gagaatagct agccctagta gaatttgtag tctatgtggt
41521 cagcagttat caggtatgaa ttacactaaa ggaaaagcat tatcaaaagt taatcatttt
41581 catttacagt attctaagta tatttatttt gatatttgcg cagatatcaa caattgttat
41641 aaaaatttaa gaaaacgagg tgaaatggat tgagtgcaga aaatattaga gatataatta
41701 acaagaaaaa gttagaagaa gaggatacaa gaaaatatat agctgatggg tttatgaatg
41761 gtatcggtaa attaatgtac gaatttaata agaaagtaga taacaaagaa atagaagtta
41821 aagacccgaa tgatttatac aaattatttg tgatattctc tcaaatgcaa aatatggtca
41881 atgaaacttc tgaaggagga gcaataccctc aactatctag acctcaacag gaattatttg
41941 atgagattac aacagaagat agtaatggag aatctacagt tgatttacag aagatatcag
42001 aaatgtcagc ggaagatatt acagcaatga tttctgaaaa ggaaaaagta atgaatgagg
42061 aaaattcaga aacattctaa ggagaaagat ataatggat ggaaaagaac taattaagat
42121 agcacaagaa acatttcaaa ctgaaaaaat aacaagagaa cagatagacc atataatcaa
42181 tatgctaaat cctctacct atatgcttaa gtatcataca ctgagagggc atcctataac
42241 ttttagtatt cctaatagag atagaagtaa agcacaggct catagacctt ggcaaaactag
42301 gattgtaaat gatactcatc ctaataaggc tgtaataaaa tcacgtcagt taggtcttag
42361 tgaaatgggt gtaatggaaa tggttcattt tgcagatatg catagttatg ctaatgcaaa
42421 gtgtctgtat acattcccta caaacgaaca aatgaaaaaa tttgttcagt cacgtttgaa
42481 ccctgtttta gagaaagaat atttttagaga cattgttgat tgggataaag actcgttagg
42541 ttttaaaaag ataagaaact ctagttttatt ctttagaaca agttctaaag caagtactgt
42601 agagggtgtg gatattgact attttatcttt agatgagtat gacagggtaa acttattagc
42661 agaatcgtct gcattagaat caatgtcttc atcaccttt aagattgtga gaagatggag
42721 cacacctttct gtacctggga tgggtataca caaattatac caacaatcag accagtggta
42781 ttacggtcat agatgtcaac attgtgatta cttaaatgaa atgagttata atgattacaa
42841 ccctgataat cttgaagaaa gtggaaatat gttatgtgtt aatcctgaag gtgtagatga
42901 gcaagctaaa acagtacaga atggcagtta ccaatttgtt tgtcaaaaat gtggtaaacc
42961 actagataga tggtataatg gtgagtggca ttgtaagtac cctgagcgta caaaaggtaa
43021 taaggggta cgaggataccc taataacaca aatgaacgct gtatggattt ctgctgatga
43081 attaaaagag aaagaaatga atacagaaatc taagcaagca ttctacaact atattttagg
43141 ttatccttt gaagatgtta aacttagagt taatgaagaa gatgtttatg gtaacaaatc
43201 acctattgca gaaacacaat taatgaaacg agatagatat tctcatatag ctattggtat
43261 agattgggga aatactcact ggataactgt tcatggtatg ttacctaatg gtaaggtaga
43321 cttaatacga ttattctctg ttaaaaaaat gacaagacct gatttagttg aagcagattt
43381 agaaaaaata atttgggaaa tatctaagta cgaccctgat attataattg cagataacgg
```

Figure 15 (contd.)

```
43441 ggactcaggt aataatgttt taaaactcat taatcatttt ggaaaagata aagtatttgg
43501 atgtacttat aaatcttctc ctaaatctac cggacaatta agacctgaat ttaatgagaa
43561 caataatagg gttacagtgg ataaattaat gcagaataaa agatatgtac aagcacttaa
43621 gacaaaggat ataagtgttt atagtacagt agatgatgat ttaaaaactt tcttaaaaca
43681 ttggcagaat gttgttatta tggatgaaga agatgaaaaa actggagaaa tgtaccaagt
43741 tatcaaacgt aaaggtgacg accactatgc acaagcaagt gtctacgcct atataggatt
43801 aacaagaata aaagaacttc ttaaagaagg aaacggtaca agctttggtt ctacatttgt
43861 ttctactgat tacaatcaag aaggaaataa acaattctac tttgatgaat agaggtgaaa
43921 tagacttgac agataaatta tttatggta caattagtaa tgaagaaatt aataaaagtg
43981 tattgaattt gttattgggt gaggaattat ccttagatta tgtttctaaa aatagtgata
44041 ctttagatgt taaatatgaa catgtttata aatctctagg attcgataat ttctttgatt
44101 gtttttata tgctaataga gagcctgaaa tagtccataa aggtggagat aaaaatcttg
44161 gtggactaaa taaggttaaa cgtactgtta ttcgtaatgg taaagaaatg gaaatgacag
44221 tttacgaaga tggtaataaa gagaacgata gtaaagaaaa acaagaagga aaagaagaag
44281 ttagtagaag tgcagtagga gcaagggcta tttctaatgg tgaagaagga aaggtaaacc
44334 ctaaaaaggt agcaaattca ttatctaatt taagtaaaaa aggtgtagat gtatcacata
44401 ttaatacaaa ctcatcattg tataaagagt ttgttgatga taacggtgat acattaggaa
44461 ttacatcttt taaacgaact gaaaatgata taatattaga atcttatgca agttcacatg
44521 attcagatgg tgtaggagca agagctatta tggaattatt acgtttaagt attaaggaaa
44581 ataaaaatgc agttgtgtat gatatagaat tacctgaagc agtagagtat ttaaaaactt
44641 taggatttaa acctaataaa gatggataca tcttaagaaa aaaagatgta aaacaattct
44701 taggtgatta tagtgatttt atttagcact atagtcatct attctattgt atttattcta
44761 tatattgtat taaaaacaat ttatataaag tctaatatga gtagaataga taacacaact
44821 gaattattaa aaatattaca ggaagatatt gaaggtaaga taaaaaagga aggaagaaat
44881 aaatgacttt agaagaaaat aaattaacat tagaagaatc aataactcca cttagcaaag
44941 aggagaaaga agatagtatt aaagaattta gcagtttatt atgtgaaatg gtaaatagac
45001 tatataagtc ttataatgta tttagacaag accctatgga tgaaactcaa cgtctagatg
45061 gctctttaat ggtctttcaa agtagattaa atgacccttt aacaggagat ttacatgata
45121 agatgtataa acttgctttt tcaaaacgta ttgatatttt cgaagctaat aagcaattta
45181 gaaaagatgt agaagcaggt aaagcaattg agttaggtga tgtagctatt atagatacag
45241 cattaagtaa catcctttca ggcaatgagt tccaaggaag tatttcattt atgcttagaa
45301 aagactttga agaaaagaa cgaattagaa aagaagaaga agagaaactt aataacttat
45361 aaaagggaag aattatgaga ctatataaaa tgaggtatca taattgaaaa agaaaccaca
45421 aggcaatgag gtaatcataa ccataataac ggttatgata gcagtatttg tagtcattat
45481 gaccatattt tttaataaat atcaagatgc taaagaagat aaagatagat atcaaagatt
45541 agtagagatt tataaaaaag cagatgataa tgatggtgag actaaaaaga aatatgttaa
45601 aagattaaat aaggctgaag aagaacttaa aaaagtaaaa aaagaaacaa attataaaga
45661 ttataataag aagtcaagta agaaaagaca aaagaagat aaagaaacta gagagaaaat
45721 atatgatgta actggtgatg atgacttaat attagtaaaa aataatattg agttagtga
45781 taaagtagac aagcccgaaa tacttattag tgaagatgga attggtacga taactgttcc
45841 tgtagatagt gggtatgaaa aacaaacagt aggttctatt attactagtg tattaggttc
45901 tccttcccta tcacctggtt caaatagtat agatggttta agtgttatta acgataatgt
45961 ttatccaaat acagtagata gcatagtaga agatacaaaa ccttctatta acttaccaac
46021 ggataatcct attataacaa atccagttga accaactata ccttcagata ttataccctcc
46081 tattgataat ccttcagttc cgatatctcc tgagaaccca ggagataata atcaaggaaa
46141 tacagataat ccaaatcctc ccctccagg gtacacagat gaagatggtg gaagaggctc
46201 cggtggtgga ggaaattctg aaccaccatc aacggaagaa ccttcggata tggtaacac
46261 cggaggagga gattgggaag aaaaacctga cccaggagaa gaaccttcag ataatggtaa
46321 tacaggagga aatggtggag aagttacgcc tgaacctgaa cctgaacctg aacctgaacc
46381 tgaacctgaa cctgaacctg aacctgaacc atctgaaccg tctgacaatc ctgatgaaaa
46441 tggaggatgg gaaactgaac caactgaacc tgagtcacct tcagagccgg acgataaagt
46501 ggacgaagaa gataaaaatg aagatactac agatgataaa cagcccactg aacaaccgga
46561 cgataacaac atagataatg aagataaaac tgaagaggag taattactcc tctttttgt
46621 ttgctatatt aaataagagc taaatataaa aaaattgaac attacggtgg tgaaaacttt
46681 gttaggaatg aatattataa cgtcactatc agtagtattt acttgtttaa gtcttttaac
46741 tttaatgatt tttgttcata gtaagttctc tagtaaaaac gttttgttt tgtatgtaat
```

Figure 15 (contd.)

```
46801 ttatgctata ataggaatag gtacatacat agttttaact atgtttcaaa caacatctgt
46861 acttattaag aatgatgtaa tagattccat agaaaatact gaacattata ttggattcaa
46921 tgaccctata attatatttta ctataagttt tataggtgca atacttggag gaatttggta
46981 caagatgatg aaaattatta aaaagagtaa ctttaaagat aaaaaataaa aaagacggtg
47041 aataggttga tattctctaa agataaaaaa tgggatgaag caaaagattt catcaaaggt
47101 caaggtatgc aagataattg gatagagatt gtagattatt atagacagat aggtggaaaa
47161 cacgtagctg tttttattgc tttaaacaaa gtaaaataca tgattctaga agcaacaaaa
47221 gacaataagg taatattagt agataaagat aataatatac tattagaaga ttatgatatt
47281 gttatggaaa gtaagaagat gttttattac attgaagaac cgttcgaggt taaaataaat
47341 atccctcaac atattagaga tgtaacttat aataatactg ttgtattaac tacagtaaga
47401 gggagtagag gtgactagta attggcagat ttatttaagc aattcagatt aggtaaagac
47461 tatggtaata atagtaccat tgctcaagtt cctattgatg aaggattaca agctaacatt
47521 aaaaaaatag aacaagacaa taaagagtat caagatttaa ctaagtcttt atacggacag
47581 caacaggctt atgcagagcc atttatagaa atgatggata cgaatcctga atttagagat
47641 aagagaagtt acatgaagaa cgaacataac ttacatgatg ttttgaaaaa gtttggtaat
47701 aaccctatcc ttaatgctat catacttaca cgttcaaatc aagtagctat gtattgtcaa
47761 cctgcaagat attcagagaa aggtttaggt tttgaggtaa gattaagaga cctagatgcg
47821 gaacccggta gaaaagaaaa agaagaaatg aaacgtatag aagattttat tgttaataca
47881 ggtaaagata aagatgtaga tagagattca tttcaaactt tctgtaagaa aattgttaga
47941 gatacttaca tctatgacca agttaacttt gaaaaagtat ttaataagaa taataaaact
48001 aaattagaaa aattcatagc agtagaccct tctactattt tttatgcaac agataaaaaa
48061 ggtaaaatta ttaagggtgg taagagattt gttcaagtag tagataaaag agtagtagct
48121 agttttactt ctagagagtt agctatgggt ataagaaacc ctagaactga attatctttct
48181 tcaggatatg gattatcaga agtagagata gctatgaaag agtttattgc ctacaataac
48241 actgaatcat ttaatgatag attcttctcc cacggtggta ctactagagg tattttacag
48301 atacgttcag accaacaaca atcacaacat gcattagaga acttaagcg tgaatggaaa
48361 tctagtttat caggtatcaa cggttcatgg caaataccag tggtaatggc agatgatatt
48421 aaatttgtca atatgacacc aactgctaat gatatgcaat ttgagaaatg gttaaaattac
48481 cttatcaata ttatatctgc tttatatggt attgaccctg cagaaattgg tttccctaat
48541 agaggaggag ctacaggttc taaaggtggt tctactttaa atgaggctga cccgggtaaa
48601 aaacaacaac aatctcaaaa taaaggttta caacctttac ttagatttat tgaagactta
48661 gttaatagac atattatatc agaatatgga gataagtata cattccaatt cgtaggtgga
48721 gatactaaga gtgctactga taaacttaat attcttaaac tagagactca aatatttaaa
48781 acagttaatg aggctagaga agagcaaggt aagaaaccta ttgaaggtgg agacattatt
48841 ctagatgctt cattcttaca aggaacagcc caattacaac aagataaaca atataatgat
48901 ggtaaacaaa aagaacgttt acaaatgatg atgagtttac tagaaggaga caatgatgat
48961 tctgaagaag ggcaatcaac agattctagt aatgatgata aagagatagg aacagatgca
49021 caaataaaag gtgacgataa tgtttatcgt actcaaacat ctaataaagg tcaaggaaga
49081 aaaggagaaa aatcttctga ctttaaacat taattaataa gcctagaata aatctaggct
49141 ttgtttattt tttcgtaat ttaattttga taaatgtaat aactatgata tactatatgt
49201 aattgatatt aatacataaa aaatattaat atttcactta caagttatta ttgttatatt
49261 attaacgtaa aagtaaataa aataacaagt ggaggtgtag acaccttttgg aagaaataaa
49321 atttaatgct tttgtaccta tggatttgaa gaaatctgta tcaacagctt ctgatactaa
49381 tgagtattct atcgtttcag gatgggctag tactccaagt atggatttac agaatgatat
49441 agttaatcct aaaggaatag atatagagta ttttaagtca caagggtaca ttaattatga
49501 gcatcaaagt gataaagttg taggtatacc tacagagaat tgctatgtgg atatagaaaa
49561 aggtttattt attgaagcaa agctatggaa gaatgacgaa aatgttgtta agatgcttga
49621 tttagctgag aaattagaaa aatcaggtag tggaagacgt ttaggttttt ctattgaagg
49681 tgcagttaaa aaacgtaata taaatgacaa tcgagttatt gatgaagtta tgataaccgg
49741 agttgcatta gttaaaaacc ctgctaatcc tgaagcaaca tgggaaagct ttatgaaatc
49801 atttttaact ggtcatggta catcacctga cactcaagtt gatgcaggag cttaagaaaa
49861 agaagaaata gcatctagca ttacaaattt agcttacgtc actaagatta aagatttaaa
49921 agagttttaat gatgtatgga atggcgttgt tgaagatttg agtaaatcta atagtatggg
49981 atatgaggaa tcagtcctta cgttacaact agctaaaggt ttatctcgta aagatgcaga
50041 actagcagta atggatataa acaaacaaaa actagaatag gtaaggagaa tacattctat
50101 gagtaaagaa atgcaaaaata ttttagaaga gtatgataag ttaaatgctc aagaggcagt
```

Figure 15 (contd.)

```
50161 ttcgaaatct gtagaagatg atgaaaagaa tacagtagaa tctaccgaag agcaagtagc
50221 agaaacaact gaagaacctg ctaaagaacc tgaaaaagta tctgaggaag atgctaaaga
50281 agcacaagag caaggtgaaa aagttgaatc tgaagaggta gcagaaggca atgaagatga
50341 ggaagttgaa aaatcagcta aagaatcaaa agaccctgta gaccaaaaag atactaagac
50401 agaaaataaa gacaacgaga aacgtaaaaa taaaaaagat aaaaaagaag attctgacga
50461 tgaagataaa gatactgacg atgataaaga taagaaagaa gataagaagg aaaaaacttc
50521 taaatcaatt tctgatgaag atatcacaac agtatttaaa tctatcttaa catcttttga
50581 aaacttaaat aaagagaaag aaaacttttgc tactaaagaa gatttaagtg aagttagtaa
50641 atctattaat gagttatcag caaaaatttc tgaaatccaa gctgaagatg tttctaaatc
50701 agtagacact gatgaagaag ctgtagaaaa atcagtaaca tctacaaacg gagagcaaga
50761 aaaagtagaa ggttacgttt ctaaatcagt agacactgaa gaacaagctg aaactggtga
50821 agcaaaatca gaagaagctg aagaagtaca agaagataac acatttaaag gattaagtca
50881 agaagaacga actaagttca tggattctta caaagcacaa gctaaagacc ctagagcttc
50941 taaacatgac ttacaatcag cttaccaatc ttacttgaac attaacactg accctactaa
51001 tgcatcagag aaagatatta aaactgtaaa agactttgca caaatttaat taatgcacaa
51061 agttgtgtta tattatacgg tgtaactaaa gaatataaat agggtacatt ttactgtacc
51121 ctacataaaa taaaaagaac acaaatgaaa ggtgataaat ttatatgact atcgaaaaga
51181 acctgtcaga cgttcaacaa aagtacgctg accaattcca agaagacgta gtaaagtcat
51241 tccaaactgg ttatggaatc actcctgata cacaaattga cgcaggagct ttacgtagag
51301 aaattttaga tgaccaaatc acaatgttaa catggactaa tgaagactta atcttctatc
51361 gtgatatctc acgccgtcct gctcaatcta cagtagtaaa atacgaccaa tatttacgtc
51421 atggtaacgt aggtcactct cgtttcgtta aagaaatcgg agtagcacca gtatctgacc
51481 caaatatccg tcaaaaaact gtatcaatga aatacgtttc tgatactaaa aatatgtcaa
51541 ttgcatcagg tttagtaaat aacattgctg acccatcaca aatccttaca gaagatgcta
51601 tcgcagttgt tgcaaaaaca attgagtggg cttcattcta cggtgacgct tcattaactt
51661 ctgaagttga aggtgaaggt ctagagtttg atggtttagc taaattaatt gacaaaaata
51721 acgtaattaa cgctaaaggt aatcaattaa ctgagaaaca cttaaatgag gcggcggtac
51781 gtatcggtaa aggttttcggt acagctacag atgcttacat gcctatcggt gtacacgcag
51841 acttcgttaa ctcaatctta ggtcgtcaaa tgcaattaat gcaagacaac agcggtaacg
51901 ttaacactgg ttacagcgta aatggtttct actcatctcg tggattcatt aaattacatg
51961 gttctacagt aatggaaaat gaactaatct tagatgaatc attacaacca ttaccaaatg
52021 ctccacaacc tgctaaagtt acagctactg ttgaaactaa gcaaaaaggt gcttttgaaa
52081 atgaagaaga ccgtgcagga ttatcatata aagtagtagt taactcagat gacgctcaat
52141 cagctccttc tgaagaagta acagctacag tatctaacgt agacgatggt gttaaacttt
52201 caattaatgt taacgctatg taccaacaac aaccacaatt cgtttctatc taccgtcaag
52261 gtaaagaaac aggtatgtac ttcctaatca aacgtgtacc agttaaagat gcacaagaag
52321 acggaacaat cgtattcgta gataagaacg aaacattgcc tgaaacagca gacgtatttg
52381 ttggtgaaat gtcaccacaa gtagttcact tattcgaatt acttccaatg atgaaattac
52441 cattagctca aattaatgct tctattacat ttgcagtatt atggtatggt gcattagcat
52501 tacgtgctcc taaaaaatgg gctcgtatta aaaacgttcg ttatatcgca gtttaataga
52561 ataagaaaaa ctgaatacaa gagaataggg ataaacttag ggtttatccc tttttatta
52621 aaataaactt gaagggattt aataaatatg ttatactata agaaactatt agataaaaaa
52681 atggctactg tttatggtac agtggagatt gacaaagatg gagtagtcaa aggattaact
52741 aaagaacaag aaaagaatt tgccaatgtt ccaggttttg aatttgaaga agaaaagaaa
52801 actactagaa aacaatcagc ttctactagt aaagaagaag agcctaagga agaggaaaag
52861 aaagcctcta ctagaaaaac tacaaatact actagaaaat ctacagcacg taaacaaca
52921 gccaaaaaag atgaaaataa gtaaagggtg aattaaatgg ttaactcaat gtttggaggg
52981 gacttagacc cttatgaaaa atcattaaac tatgaatatc cttatcatcc tagtggtaat
53041 cctaaacaca tagatgtaag tgagatagat aatttaacat tagctgatta tggatggtca
53101 ccggatgcag ttaaagcata tatgttcggt attgtagttc aaaatcctga tacaggacag
53161 cctatgggtg acgagttcta taaccatata ttggaaagag cggtaggtaa agctgaaaga
53221 gcattagata tatctatact acctgacact caacatgaga tgagagatta tcatgacaac
53281 gagtttaata gttacatgtt tgtacatgct tacagaaaaac ctatattaca ggtagagaac
53341 ttacagctac agttttaatgg tagacctata tataataacc ctgctaactg gtggaaagta
53401 gagcatctag caggacatgt tcaattattc cctacagcac ttatgcaaac aggacaatca
53461 atgtcatacg atgcagtatt caatggatac cctcaattag caggtgtata cccaccatca
```

```
53521 ggagcaacat tgcacctca aatgatacga ttagaatatg tatcaggtat gcttccacgt
53581 aaaaaagcag gaagaaataa accttgggaa atgcccctg agttagaaca gttagttata
53641 aaatatgcat tgaaagaaat ataccaagta tggggtaact taattattgg tgccggtatt
53701 gctaataaaa cattagaagt agacggtatt acagagacaa taggtactac tcaatcagct
53761 atgtatggtg gagcttagtgc tcagatactt caaataaatg aagatataaa agaactatta
53821 gatggtttaa gagcttactt tggatataat atgataggat tataaggagg gttagaaaat
53881 ggaaaaaccg tatatgatag gagctaactc taaccctaat gttattaata agtcaacaac
53941 atatactact acaacacaag cagatgaaca agataaacct aagtatacta ctagactaga
54001 gtttgatacg attgacatga ttaggtttat taatgaccga ggtataaaag tactatggga
54061 agaagcatat ttctgtcctt gtcttaatcc tgatacagga catcctagag tagattgccc
54121 tagatgtcat ggtaaaggta ttgcatatct acctcctaaa gagacgataa tggcaataca
54181 gtctcaagag aaaggaacta accagttaga tataggtata ttagatacag gtactgcaat
54241 aggtaccact caattagaaa agagaaattc ctatagagac aggtttactg ttcctgaggt
54301 attgatgccc caacaaatga tttattttgt gaataaagat agaattaaaa aaggtatacc
54361 tttatactac gatgtaaaag aaataactta tatagccact caagacggta cagtctatga
54421 agaagattat gaaatcaaga ataatagatt gtatttaaat gaaaaatatg agaatcatac
54481 agtaacttta aagatactta tgactttaag atatgtagta tcagatatac taaaagaaag
54541 tcgttatcaa tatactaagt ttaatcaacc taaatcaaaa tttgaaaact tacctcaaaa
54601 attacttctt aaaagggaag atgtcattgt actacaagac ccttataaag ttaatgatgg
54661 tatagaagaa gacctagaaa ttcaagtaga tgaccctaag gcttcggcat ctaatcctag
54721 taatttaggt ggattcttcg gaggtgcatt taaataatgc cagttcatgg aaagagacct
54781 aattatttta aaaataaaaa ctataagcag gtaggtaaga gaacaattga tggtatgcgt
54841 tcagaagttc ttgataaatt acaagcaaca gcacagcaag tagagaatac tagtattaaa
54901 cgtatgccta ctatctaca aataacagag aaaaagcttg aaaaagaagg agtagtagac
54961 cttaaaaaag cttttgctca ctcatctaaa aagaaaacta gtaaagatgg cggatggtat
55021 ttaactgtac caatccgcat caaaactagt agaatgaata acagtactta tcaagatatg
55081 agaactttaa aagtagaaaa aggaacaggt tcagtttcga agataactga ttacctagaa
55141 ggacgtagga agaatgtaag ccacccttca atgaagcctg aacctatgac tcataatatg
55201 actaaagtta aagaggaaaa gcaatcttct tactttatat ttagaactgt ttctagtaag
55261 tcacctgcta gttcttggat acttaacaga gataaagtta atgaagataa cttctctaaa
55321 acaactctaa aaactgttaa gcaattaatg aactggaaga tgaaaaattt aaattaagag
55381 gagggttagt attaaatggc aataacatca gttgattcat atttattatc agaaataaag
55441 cctagactta acactgtgct agagaattgt tatattatag atgaagtttt aaaagacttt
55501 gattatcaaa ctagagagag ctttaaagaa gctttctgtg gtaagaatgc acaacatgaa
55561 gtaacggtag gatttaactt cccaaaattt aaaaataact atgaagctca ttacttgata
55621 caattaggtc aaggacaaga gacaaaaaac tctttaggga gtattcagtc atcttacttt
55681 gaggcaacag gagatacttt agtcgaatct tctacagcaa taagagaaga tgataagtta
55741 gttttactg ttctaaacc aataggagag ttaataaagg tagaagatat agagttgct
55801 aaatacgata atcttcaggt tgaaggtaat aaggtatcat ttaagtatca aacaaatgaa
55861 gattatgaga actacatgc taacattata ttaccgaaa agaaaaatga ttctaaaggt
55921 ttagtaaaag gattcacagt tgaagaacaa gtaacagttg taggtctttc atttaatgta
55981 gacgttgcaa gatgtttgga tgctgtactg aaaatgattt taatatctat gagagatagt
56041 atagaagagc aacaaacatt ccaattacag aatttgtctt ttggtgatat tgcaccaata
56101 atagaagatg gtgactcaat gatttttggt agaccaacaa ttattaagta cacaagttct
56161 ctagattggg attatactat tacacaagat attaataaac taactttaa agaaagaaag
56221 gattggaagt aggatggcta gaaaaaagac acctgaaaat aacactccta aatttaatgg
56281 ttatgttcat atagatacat tccttgatac tgcaaaaacc cttttaata tgagggattc
56341 acaagtagca ggatttaaag cttatatgga aggtagtcat tatttgttta gtgagcaaga
56401 attcttacca tcattagaga agtatctagg taggaaatta gatatataat aacattcaga
56461 taaggagaat taaatatggc agtagaacca ttcccaagaa gacctattac ccgtcctcat
56521 gcatctattg aagtagatac ttcaggtayc ggtggctcag caggttcaag tgaaaaagta
56581 ttttgcttaa tcggtcaggc tgaaggcgga gaaccaaata cagtttatga attacgtaac
56641 tatkcacaag ctaaacgttt attccgttca ggagaattac ttgatgcaat agaattagca
56701 tggggttcta accctaacta tacagcagga cgtatttttag ctatgcgtat agaagatgct
56761 aaacctgctt cagcggaaat tggcggatta aaataacat ctaaaatcta cggtaatgtt
56821 gctaacaaca ttcaagtagg attagaaaag aatacactaa gtgattcatt acgtttaaga
```

```
56881 gtaatattcc aagatgaccg tttcaatgag gtttatgata atatcggtaa tatcttcaca
56941 atcaagtaca aaggagaaga agctaacgca actttctctg tagaacatga tgaagaaact
57001 caaaaagcaa gtcgtttagt attaaaagtt ggagaccaag aagttaagtc atatgtttta
57061 actggtggag cttatgacta cactaatgct attattacag acattaatca attacctgat
57121 ttcgaagcta aattatcacc tttcggagat aagaacttag aatctagcaa attagataaa
57181 attgaaaatg caaatataaa agataaagct gtatatgtaa aagcagtttt tggtgactta
57241 gaaaaacaaa cagcttacaa tggtatcgta tctttcgagc aacttaatgc agaaggagaa
57301 gtaccaagta atgtagaggt tgaagcagga gaagaatcag ctacagtaac tgctacttca
57361 cctattaaaa ctattgaacc gtttgagtta actaagttaa aaggcggtac taatggtgaa
57421 ccacctgcta catgggcaga caagttagat aaatttgcac atgaaggcgg atactacatt
57481 gttccattat catctaaaca atcagttcat gcagaggtag cttcttttgt taaagaacgt
57541 tctgatgcag gagaaccaat gagagctatt gttggtggag gattcaatga atctaaagaa
57601 caattgttcg ttagacaagc atcattatct aatccacgag tatcattagt agctaactca
57661 ggtacttttg ttatggatga tggacgtaaa aaccacgtac ctgcttacat ggtagccgta
57721 gctctaggtg gtcttgcaag tggtttagaa atcggtgaat caatcacatt caaaccacta
57781 cgtgtaagtt cattagacca aatctatgag tcaatagact tagatgaatt aaatgaaaat
57841 ggtattatta gtatagagtt tgttcgtaac cgtactaata cattcttcag aatcgttgac
57901 gatgtaacta cattcaacga taaatcagac ccagttaagg ctgaaatggc tgttggggaa
57961 gctaatgact tcttagtaag tgagcttaaa gttcaacttg aagaccggtt tattggtact
58021 cgtactatta atacaagtgc ttcaatcatt aaagacttta tccaatctta cttgggtcgt
58081 aagaaacgtg ataatgaaat tcaagacttc cctgctgaag acgtacaagt tattgttgaa
58141 ggtaacgaag caagaatttc aatgacagtt tacccaatca gaatcttcaa gaaaatctct
58201 gttagcttgg tttacaagca acagacatta caagcctagt ctaggtgacg gagtacctgg
58261 attaggtact cctattaata taatttgaat acttaggag agtgaataca gatggcatca
58321 gaagctaaac aaaaccgtcc atactggtaat accgtcctac ttatgattaa aggtaaaccg
58381 gtaggaagag cacaatcagc atcaggtcaa cgtgaatacg gtacaactgg tgtatacgaa
58441 atcggttcta tcatgcctca agaacacgta tacttacgtt atgaaggtac aattacagta
58501 gaacgtttac gtatgaaaaa agaaaacttt gcagatttag gatatgcttc acttggtgaa
58561 gaaattctta agaaagacat cattgatatt ttagtagtag ataacttaac aaaacaagtt
58621 attatttcat atcatggttg tagtgctaat aactacaacg agacataact ttttctgct
58681 gtgtctctgt acagtgatgt ataacaaaaa aacccttcta attcatggga acccttaaca
58741 gataatgctg aaggcaatca tgagccaagc ctagtaaagt actaggaagg tgcaacgact
58801 agagaaaaga tagtttactg ttataggcag taaatgaaaa ctgagtatcg tacatctaag
58861 tagatggaaa tggagggatt cctaaagtaa cgtttaggaa tgtgatatag tctagtctat
58921 atggaaacat atagaaggta agaagtaacg actcttatcg taataataac aggcagacca
58981 atgaaatcgt aactgaagaa attgagtaga agaatgctcc tttaactaga aatagttata
59041 gcaaatccct ttaattcatg ggaaccctta acagataatg ctgaaggcaa tcatgagcca
59101 agcctagtaa agtactagga aggtgcaacg actagtcaga atgacgtaca tctaagcaga
59161 tggaaatagg ggacaccttc aatattaagg tgaagatata gtctgaacta tatagaaata
59221 tatgaaggt tcaagagtag cgtttgaat cgtaacaaat ttgtttctta tttaacagct
59281 agtgataaag cccgtaccta aagggtttaa agacctaaca ataaaagtta ggtctttttt
59341 attgacatat aactaacgat atggtaacat taaaatataa tattaaagag gtgttaagaa
59401 tggataaaaa aataatagga ttaaatacaa aaacattaga agagaaggtt tttactacta
59461 taaaagaagc agaaaaagaa attgaattaa gaggtaccgt taaaagatgt ttaaataatg
59521 aaattaagtc tactaaagga tggttattta ggtatgaaaa tgaagatttt cctgagaagg
59581 caagaacaat aacagacaaa agaattaagg ttgttgtttt aagtaaagaa caggaacaaa
59641 taaagttacc tcttgagatg gctaaaaatt tatatggaat acctaaacct atgattattg
59701 aagctattca atataaaagg aaaattaatg gctactctgt tagaagagct acaaaagaag
59761 agcaaaagat tacattatct aacattagtt atatagacta tataaaaaca gttaataacc
59821 caaacaatat taaaattatt aaaaataagg gtctttttgg tgaacagtta gttaagacaa
59881 tattagacta taataaatata gaatataaaa gggaatattc tttaagaat gaattaggga
59941 caatacaaag aatggatttt ttagcagtag tagataataa aaaatactgt attgaatata
60001 tgggtgagca acattatgta gagaaaggta ataagtgggg ctcgttagaa aagagacaat
60061 ttctagattc tataaagaaa aaatactgtt acgaaaatgg gatatactat attgatatca
60121 gttataaaaa cagtgattta gagagtgtat tcaatgttat taataaacac ataccaggta
60181 ttaaaaaacc aaataaatct attattgata ttggtgtgac aataaatata gaagaaatgt
```

```
60241 tagaatacta taaggagcat actaaaaaag aaacagctta taaatatgga gtaaaggaac
60301 ataatattga taacttatta gtaaatttaa actatgaaag caaaagaaaa cctaaagata
60361 taatacaagt atataagaga gatgaaaaaa tatttgaggg cacttataat gaaattaagg
60421 atgaatttaa ttttactatg agtaatgttt tgaaatgttt aaatggagaa ctagataaaa
60481 catcacaaca ttactttaaa tataaagatt cagaaaaaga tagagttaga caactaaaga
60541 ctaaagaaag acataataaa agaggaacag taagaggaag tagtaacaag gatgtcgttc
60601 tcaaggacat atattcagga gaggaaactg tatattcttc tattaaggag tgtcacgaaa
60661 taacaggtct aaacaaagac aaattataca agttatttaa tccaaataaa agtaaacaaa
60721 ttatagacaa atatataggt aaaagctatg gcggtgaata ccctataact gtagaagagg
60781 ctctaaatat aattaaccct tgaccagtat caagggttat gttattataa taaataagaa
60841 gggattatat tgacaaacaa aagaaaaaca ataggtaaaa taagtaactc aagagcaaca
60901 tggaatatta atccggtaac taaagttaaa aaagataaaa caaatattc tagaaaaaat
60961 aaacataaag gtcttgacaa ttataattaa ctaaggtata ttattagtat aacaaaaaaa
61021 ggagatgggt atatgagtac attttggtca gaaagaagaa caactaataa agataggcaa
61081 gttaaaaaac attatactca aatgagtatg tatgaaagaa agaaatgtgt agagttatta
61141 caagagacaa ttactgaaaa tagaattatt aattttacac gacatagtgc aaaaaaggtt
61201 aaaggtaaac caacaacaaa tatacctaaa ttaataggtt ttatttttaa aaataagttt
61261 gcctacgaaa atatcataga gtacaataac acagattata atggtaatat tgagaggaga
61321 attgttgtta aacatcctaa agttataact gtagaaggaa aacctagcta tcagtttttg
61381 acaattagtc ttgaagatgc tagagttatt acggtgtggt ataacagtgt agatgataca
61441 catagaacac tagatttaaa ttattatagt aaagacttga caattcaata aggaggtatt
61501 ataatgggta taacaatagt aaatagttat tttattctgt ctagcatttt cctcatcata
61561 ttaaccatat taaatggtaa gggtacagtt acaagggaat cattaactat gagtaaaata
61621 ttagtagtaa taacatcaat tcaattttta gcatgtttaa ttattaatgg tatttattgg
61681 tcactaaaat ttatgtagta gaactagaat aaaagtattg acaaattaaa actaataaat
61741 tataataaag gtataacaaa ttaaaggaga agatataaaa tgtcacaaga taattaaga
61801 gcaatttaca cagaaatgaa agtagaatta cacaaatttc ctaaagaggt agatataaca
61861 agtaaatcaa ctgcaattgc aatcaatcag attttagata aattcaaaac attaacagaa
61921 caagcaggaa agattactag aaaatattta gaaggtcaag aaatattaac tattgattat
61981 gagtattatg attcattaca agaatactat atttacctac ttagaaaatag tgaaaagatt
62041 gaacaaagtt tacaagaaat tactaagcgt acaggtgaat atgtaaagta attttgattt
62101 aaaaacaaaa tatgatatac tatgtttaaa gtagtaagcc tacactagtc cgtgttatat
62161 taatattgaa tcggataagc gtaggcttta ttaatattta aaaaaggaag gtatatcata
62221 ttatggcaga agaaattaaa aaggaacaag atgtacaaga aacaactaaa gaagaaaaaa
62281 aagatgttag taaaatgaca ccggaagaaa tagataaatt aaaatatcaa gacaaacaag
62341 aaaaagaaca agttattaac aaagttatta aaggcgttaa tgatacttgg gaaaaagaat
62401 ataactttga agaactagac ttaagattta aagttaagat taaattacct aatgcacgag
62461 aacaaggtaa tatctttgcg ttacgttctg cttacttagg tggtatggat atgtaccaaa
62521 cagaccaagt gattagagca tatcaaaatgt tagctaccct acaggaagta ggtattgaag
62581 ttcctaagga attccaagac cctgacgata tttataactt atatccttta actgttatgt
62641 atgaagattg gttaggattc ttaaactcct ttcgttacta atagtataga aacattagat
62701 aaagatatag aacgattggg cggtatggaa tcaattgtta aacaaccttt atctagaaat
62761 ctatgggcta ttatgaaaga gtttaatgtt ttacctaccg agcaaagatt taaggactta
62821 gacgattatc agatagagtt tattattggg aatatgaaca gagatgttta tgaacataac
62881 aaacaactta aacaagctca aaaaggtgga aaattcgata gtcaattcga agatgatgat
62941 agtagttggt ggaatgaatc tcatgaagac tttgacccag tacctgattt cttagatgct
63001 gatgatttag cacaacaggt ggaagctaaa ttatccgata gagataagga agaaagagct
63061 aagagaaacg atgcggagtt aaatgatgaa acagaaggac ttactacaca acatctagct
63121 atgatggaat acatcagaca gaaacaacaa gaattagatg atgaagtagg aaatggtaag
63181 actagtgaag aggatgctac tatatcacaa gatagcgtta ataaagcact agaagaccta
63241 gatgatgact ggtatatgta aagggtggta ggtgatacta ccatccttat tttttaaaa
63301 tggatggtga ataatgatgg caatgaatga tgattataga ttggtcttgt ccggtgatag
63361 ttcggattta gagaatagtc tgaaggcaat agaactttat atggattctt tagagtctaa
63421 gaatattgat gctcctttag ataatttctt aaaaaaatta aaagtaattg ctaagaagt
63481 taaaaatgta cagaacgcaa tggataaaca agatggtaaa tctgttatat cttctaaaga
63541 catggatgaa tctattaaat ccactcaatc tgctacaaag aatataaatg aattaagaa
```

```
63601 agctttagat gaccttcaaa aagagaatat atctaaaggt attgcacctg accctgaagt
63661 tgaaaaagca tatgctaaga tgggtaaagt tgtagatgaa actcaagaaa aacttgagaa
63721 aatgtcttca caaaaaatag gttctgatgc tagtattcaa aatagaatta aggaaatgaa
63781 aaccttaaat caagtaactg aagaatacaa taaaataagt aaagattcta gcgcaactaa
63841 agattataca aaacgattaa gagctaatcg taatatgact agaggttaca tggagcgttc
63901 agaaggaaca ggacgattaa catatgacca aggtgcacga gttagaagtg agctaggtaa
63961 aataagttct tatgagagcc aaagaaaaca aaaccaacgt aatttaggac aagcaagaga
64021 gcaatatagc aactatagaa atcaacaaca agacttgact aaacgtagag ctagcggtca
64081 aattaataag gaacaatatg aacaagagtt agcttctatt aaacaggaaa tgaaagctag
64141 agaagaactt atatctaact atgagaaatt aggagcagaa cttgataaaa cagttcagta
64201 ttataagggt tcagttcaaa aggatttcca atctagagat gtagaccaac aacgaggaac
64261 atttggtaga atggttcaag aacgtttgcc atctattggt tctcatgcta tgatgggtac
64321 tacagctatg gctacaggtt tatacatgaa gggtgcctca ctaagtgaaa ctaatagacc
64381 tatggttaca tcattaggtc aaaattccga taatatggat atagattcta taagaaatgc
64441 atatggagac ttgtcaattg ataacaaatt aggttataat agtactgaca tgttgaaaat
64501 ggctacttca tatgaagcat cagtaggaca taaaagtgat gaggacacaa tggcaggaac
64561 taaacagctt gctattggag gacgttcttt aggcattaaa gaccaagaag cttatcaaga
64621 gtctatgggt caaatcatgc ataccggtgg agtaaattct gataacatga aggaaatgca
64681 agatgcattc ttaggtggta ttaaacaatc aggcatggtt ggtcgtcaag atgaacaact
64741 taaagcacta ggttctatag cggaacaatc aggagaagga agaactctaa ctaaagacca
64801 aatgagtaac cttactgcca tgcaatctac ttttgcagag tcaggaagta aaggattaca
64861 aggtgaacaa ggtgccaatg ctattaacag tatagaccaa ggacttaaaa atggtatgaa
64921 tagttcttat gctcgtatag caatgggatg gggaacgcaa taccaaggtc ttgaaggtgg
64981 atatgattta caaaaacgta tggatgaagg tatatctaat cctgaaaact tgacagatat
65041 ggctgatata gctactcaaa tgggtggcag tgaaaaagaa caaaaatacc tatttaatag
65101 aagtatgaaa gaaataggcg ctaacctaac tatggagcaa tctgatgaaa tatttaagga
65161 tgctcaatcc ggaaaactgt ctaaagaaga gttagctaag aaagctaaga aaatgaaaa
65221 agaaggtaaa aaagaaggag aagataacgc cactgattat aaagaatcta aatcaggaaa
65281 aaatgaccaa aataaatcta agactgatga taaagcagaa gatacttatg atatggctca
65341 accactaaga gatgctcata gtgctttagc aggtcttcct gccctatat atttagctat
65401 tggtgctata ggagcattta cagcttcact aattgcatct gcaagtcaat ttggagcagg
65461 tcacttaatt ggtaaaggag ccaaaggact tagaaataaa tttggtagaa ataaaggcgg
65521 tagctccggt ggtaacccta tggcaggtgg aatgcctagt ggtggtggtt cacctaaggg
65581 tggaggctca cctaaaggtg ggggcactcg ttctactgga ggaaaaatac ttgatagcgc
65641 taaaggtctt ggaggattcc tagtaggtgg cgcaggatgg aaaggtatgt ttggcgggga
65701 gtctaaaggt aaaggcttta acaaacatc taaagaagcc tggtcaggta ctagaaaagt
65761 atttaataga gataatggta gaaaagccat ggataaatct aaagatatag ctaaaggtac
65821 cggtagtggt cttaaagata tctataatga tagtatattt ggtaaagaaa gaagacaaaa
65881 cctaggagaa aaagctaaag gttttggtgg caaagctaag ggtctctatg taagtttgc
65941 tgataagttt ggtgacggag gtaaaaatgg tattctttca caatcaccaa aagcaggtgg
66001 aagtggcata gggaaacttg gaaaacttgc aggtggaact ggaaaaggag ccggagtttt
66061 aggtgttgct acgtctgcct tatcattaat acctgcttta gctccggag atagtaaagc
66121 tatcggcgga ggaataggct ctatgggtgg aggaatggca ggtgcatcag caggagcttc
66181 tataggagct ttatttggtg gtgtaggtgc aatacctgga gctttaatag gtggagctat
66241 aggttccttc ggaggaggag ctgttggtga aaaagtcgga gacatggcta aaaagctaa
66301 cactaaagaa ggatggaacc taggatggac taacggagat aaggatggta agaataaatt
66361 ccaagattct ttattaggaa aacctatatc taaagcatgg agcggtataa caggtctctt
66421 tgataatgac gctgaagcat ccgaagaaga tagtaaagat aagaaaaaag gtgttaaagg
66481 cgttaaagga gatactaaga agaaagaaa aatgacagca gaacaactta gagaaaagaa
66541 taaccaatct gaaactaaga atcttaaaat ctatagtgat ttacttgaca gagctcagaa
66601 aattattgag agtgctaaag gtattaatat agatggagga acttctgata gtggttctga
66661 tagtggaggc tctgcatctg atgtaggtgg agaaggcgca gagaagatgt acaagttcct
66721 taaaggaaaa ggactatctg ataatcaggt aggagctgtt atgggaact tacaacaaga
66781 atctaatctt gaccctaatg ctaagaatgc ttctagtgga gcatttggta ttgctcagtg
66841 gttaggggct agaaaaacag gattagaaaa ttttgctaaa tctaaaggta aaaaatctag
66901 tgacatggat gttcaattag attacctatg gaaagaaatg cagtctgatt atgaaagcaa
```

```
66961 taatcttaaa aatgcaggtt ggagcaaagg tggaagctta gagcagaata caaaagcatt
67021 tgctactgga tttgaacgta tgggagcaaa cgaggctatg atgggtactc gtgttaacaa
67081 tgctaaggaa ttcaagaaga aatacggagg ctccggtggc ggaggtggtg gaggagccct
67141 atcctctact taccaagaag ctatgagtaa tcctgtatta actactggtt ctaattatag
67201 gggctctaat gatgcttcta atgcttctac aactaacaga ataaccgtca atgttaatgt
67261 tcaaggtgga aataatcctg aagaaactgg agacattatc ggaggaagaa ttagagaagt
67321 tctagatagt aacatggata tctttgcaaa tgaacataag agaagttatt agtaattttg
67381 tattgacaca agagtagtat catagtatac tactcttata catataaaaa ataaaaggaa
67441 gtatgtgtat atgcgtagaa taagaagacc taaggtaaga atagaaatag ttacagatga
67501 taatacattt acattgagat ttgaagatac acgagactat aatggtgatg agtttggagc
67561 taaactttta ggattccaaa ctaaaaactc tatggaagat gatagttcag ttttccaaat
67621 aaatatggca ggagatactt attgggataa gctagttatg gctaatgata tcataagaat
67681 attattaca cctaatgatg accctaacga taaagaagga aaacaagaac gacttatcca
67741 ggtaggtatg gtttctcaag tatcaaaagt aggtagttac ggtaatgacc aaactcaatt
67801 tagaataaca ggtcaatctt ttgtaaaacc ttttatgaaa tttggattag gcgttattca
67861 ggaagttcaa gctgtattac ctgaagtagg ttggcttatt gatggtgatg gagataatga
67921 agtaaaattt actggtagct cagctcatga agtaatgact ggtattatac gtagatttat
67981 acctatatg aaatataact atactgaaaa aacatataat acaattgata actatcttga
68041 ttatgatgat ttaagtagtt gggatgagtt tgaaaaactt acagaagttt cagccttttac
68101 taattttgat gggtcattaa aacagttaat ggatatggta acagctagac cttttaatga
68161 gttattcttc aaaaattcag aaaaaaacacc tggaaaggct caacttgtat taagaaagac
68221 ccctttaat cctactgagt ggagagcttt agatatgatt aaagtaccta ctgaggattt
68281 tatagaagag gatgtaggta aaagtgatgt agagacatat tctatattta cagcaacacc
68341 tgcaggtatg ttgaaagagc ttaacggtga tgtattttct aaaccacaat tccaccctga
68401 attaactgat agatatggtt atactaaatt tgaagtagaa aatattttatc ttagtacaaa
68461 atcaggttca gctactgagg attcagattc ttcaggtgat gataatggca cagaacgagg
68521 aacttattct aaaattatga aagatttaag taactatgga agagataata tatctaaagg
68581 tatagataag tatacaagta aattatcttc aaaatataaa aacttaaaaa aagcccaagc
68641 taaaaaaatt atagagaagt ttgttaaaga aggaaaagta acagaaaaag aatatgaaaa
68701 aataacaggt aataaggtag atgatgaatt aacatcagat aacagaccga agttgacaaa
68761 agataaatta aagagtatac taaagagaa gtttaaaaaca caagatgatt ttaataattc
68821 taagaaaaag aaaaaagcta agacagatgc acttaaagaa ttgacaacta aatatcgttt
68881 tggtaataaa acacatgcta caactttatt tagatgaatat attaaatata aaggagagcc
68941 acctaacgat gaggcttttg ataaatatct taaagctatt gaaggtgtta gtaatgtagc
69001 tacagacaca ggttcagatg caagtgatag ccctttagtt atgttttcta gaatgctatt
69061 taattggtat catggtaacc ctaacttcta tgcaggagat attattgttt taggagaccc
69121 taagtatgac ctaggtaaaa gattatttat tgaagataag caacgaggag acacttggga
69181 gttctatatt gaatctgtag aacataaatt cgattataaa cagggtatt atacaactgt
69241 aggagtaact agaggttaa aagacgctat tctagaagat ggtaaaggta gtccgcatag
69301 attttgcagga ttatgaaatc aatcatcaga cttcatggga ggtcttatgg gtgaagatac
69361 ttctaaagaa cttaaagaaa aaggtgtagc agagaaacaa agtagtggag ataaagatgg
69421 tggttctgat agtggtggag ctcaagatgg tggctcttta gattcactta aaaatatata
69481 cggcaaaactt cctaagcatg acccaagttt tgttcaacct ggtaaccgac attataagta
69541 tcagtgtaca tggtatgctt ataatagaag aggtcaatta ggcatacctg tgcctttatg
69601 ggggacgcc gccgactgga taggtggtgc taaaggagca ggttatggtg taggtagaac
69661 acctaaacaa ggtgcttgtg ttatatggca aagaggagtt caaggaggta gcccacaata
69721 tggtcacgta gcgtttgtag agaaagtatt agatgggaggt aaaaaaatat ttatctctga
69781 acataactat gctaccccta atggatatgg tactagaacg atagatatga gttcagccat
69841 aggtaagaat gcacaattca ttacgataa gaaataagg aggatagtct atggcaacag
69901 ataaagaagc taaagatgtt attgataaat ttatagacaa tgtatttaat tttgatgtac
69961 ttacaaaaga aagaataaaa gaaaaagatg aagaaattaa aaaaataact acagatgata
70021 tgtatgaaaa ggttgtgtat atacgacctt atgttggagt aatacaaagc cttaacccctc
70081 agcatgttca gtatgaatca ttttctaata atggttatga tataagaggca gaattaagtt
70141 tcaggaaagt aagttatttta gttgataaag ggtctatacc tacagattct ttatctactt
70201 taacagttca tttagtagaa cgaaatcaag aactattaat agattacttt gatgagatac
70261 aagatgtgtt gtatggagaa tatatggaag aagaatatgt atttgatgaa gatgtaccat
```

```
70321 taagtacgat actagcatta gacttaaatg ataatcttaa atccttatca aatataaagt
70381 atatgttcaa aggtgctcct aaagagaatc catttggaac agataaagat gtttatatag
70441 atacttataa cttattatac tggttatatt taggtgaaga tgaagagtta gcatatccta
70501 tgaatattaa ctacttcttt acagagggaa gattctttac tatattcggt aaaggacata
70561 agtataaggt agatgttagt aaatttatag ttggagatat attattcttt ggtagaagtg
70621 atactaatat aggtatttat gtaggagatg gggagtttat atctatgatg ggtaaattcc
70681 ctaaagatga aacacctata ggaaaatata aacttgatga ttactggaat gaatttaacg
70741 gaagagttat gagattcgat gaagaggtgt atatttaatg gtagtaaagat tccaatcttc
70801 catgggaga agtttaaaaa gagtagattc ggatgattta aatgtaaaag gattagtttt
70861 agctacagtt agtaaaatta attatataata tcaatcagta gaagttaaag ttaacaattt
70921 aactctagga agccgtatag gtgatgatgg tagcttagct gtaccttatc ctaaatcttt
70981 cataggaaga acacctgaag gaagcgtatt cggtacaaaa cctcttatta ctgaaggttc
71041 tgtagtatta atagggtttc taaatgatga tataaatagt cctattattt taagtgttta
71101 tggtgataat gaacaaaata aaatgattaa taccaatcct ctagatggag gtaagtttga
71161 tacagaaagt gtttataaat atagtagttc actatatgaa attttaccat ctttaaatta
71221 taaatatgat gatggagaag gaacaagtat taggacttat aatggtaaat catttttctc
71281 tatgacatca ggtgaagaag agaaacctca ggcaacagat ttttatactg gaactgagta
71341 tcaagattta tttacttctt attatggtaa taagacatta attgagccta gaatacaaaa
71401 ggctcctaat atgttattta aacatcaagg agttttttat gatgatggca cgccggataa
71461 tcatataact actttattta tatctgaaag aggggatata agagcctcag tttaaatac
71521 agaaacacag aaaagaacta cacaggaaat gtcaagtgat gggtcttata gagttatcaa
71581 acaagatgac gatttaatgt tggatgaagc tcaagtttgg attgagtatg gtattagtga
71641 agataataaa ttttatatta aaaatgacaa gcataaaatt gaatttactg atgagggaat
71701 ctatatagat gataaaccta tgttagaaaa cttagatgag agtatagcag aggctatgaa
71761 gaatttgaat gaaatacaaa aagaactcga tgatataaac tacctctcta agggtgtagg
71821 taaagacaat ttagaagaat taatagagtc tacaaaagag tctatagaag cttctaaaaa
71881 agcaacttca gatgtcaata gacttacaac tcagatagca gaagtgagtg gtagaactga
71941 aggtattata acacagttcc aaaaattag atgagagact tttaaagatt tttatgaaga
72001 tgcttctact gttattaatg aagtaaatca gaatttccct actatgaaaa cagatgttaa
72061 gaccttaaag actaaagttg ataacctaga gaaaactgaa ataccaaata ttaaaactag
72121 attaacagaa ctagagaaca ataataacaa tgctgataaa ataatctcag atagaggaga
72181 acatataggt gctatgatac agttagagga aaatgtcaca gtacctatga gaaaatatat
72241 gccaatacca tggagcaaag ttacttataa taatgcagag ttttgggatt ctaataatcc
72301 tactcgatta gtagtaccta aaggaataac aaaagtaaga gttgcaggta atgttttgtg
72361 ggactctaac gccacaggac aacgtatgtt gagaatattg aaaaatggta cttatagtat
72421 aggattacct tatacaagag atgtagctat atctacagca cctcagaatg gtactagtgg
72481 agttattcct gttaaagaag gagattactt tgagtttgaa gctttccaag actcagaagg
72541 tgacagacaa ttcagagcag acccttatac atggtttagt attgaagcta tagaattaga
72601 aactgaaact atggagaaag acttttatgct tataggacat agaggagcaa ccggatacac
72661 agatgagcac acgataaaag gatatcaaat ggctttagat aaaggtgcag attatataga
72721 attggattta caattaacaa aagataataa gttattgtgt atgcatgatt ctactataga
72781 cagaacaaca acaggaacag gtaaggtagg agatatgacc ttatcttata tacaaactaa
72841 ctttacatct ctcaatggtg agccgatacc atctcttgat gatgtactaa atcattttgg
72901 aacaaaagtt aaatattata tagaaactaa acgtccgttt gatgctaata tggatagaga
72961 attattaact caattaaaag caaaggatt aataggaata ggttcagaga gattccaagt
73021 aattattcaa tcatttgcta gagaatcttt aattaatatt cataatcaat tctctaatat
73081 acctttagct tacctaacaa gtacattttc tgaaagtgaa atggatgatt gtttaagtta
73141 tggttttat gctattgcgc ctaaatatac aactataact aaagaattag tagatttagc
73201 tcatagtaaa gggcttaaag tccatgcatg gacggtaaac acaaaagaag aaatgcaaag
73261 cttaatacaa atgggtgtag atggattctt tacaaactac ctagatgaat ataaaaagat
73321 ttaatattaa agacctatta atttaggtct tttttagtt gtaatttaaa ctagttcgtg
73381 atatatagt agtatgagat ttatatacat actgaaaagg agaggataaa atgccacaat
73441 cagatggaat aagtaatctt catagaatac ctttacgctt ccctaaagaa ggcggtggtt
73501 atgatatgta tagatttaaa gttaaccctg agaactacac aatagattca ccacaacgta
73561 cgacagcaat taaaacaaaa tcagatattg taatagaaga ttatggtaaa gacatagaag
73621 ttattaactt cacaggtaca actggtttta gacctgttag agaagcagat ggattaaaaa
```

73681 caggtaagca gaaaatggaa gagttacaaa gtagagttag tgaatatgct atgcaaggtg
73741 gcagtggtaa tgtaagtggt tcttacttac aattttttaa ctttacagat gatagttatt
73801 ataaagttca tttagctcct caggggttaa agataaactag gtctaaagat gaaccattac
73861 tttttagata tgaaataaca ttagtagtta ttggttcatt aacagaagca gatagaagtg
73921 ctgtaacaac agaagagttt ggtaacgtta aacctaatgc ttctcaaaga gtagatgagg
73981 gtataaaaga attagataaa aatgctcgta aaacgagaga tagaaacaat caagaaatat
74041 ctagaagaga aaatacaata cctaaatcta caggagataa tacgaacgag ggtaatagac
74101 ttaagcaaag cttccctagt agttctatat ataatcctag acaatctact aacggattaa
74161 aaggtaatat tgacaatatg gcgctgataa taggttacgg tgatggaggt gtatctagct
74221 aatgaataat tttataccac aacctcaagg tctacttaga ttttaaata cctagatac
74281 agatttaact tcttctcata tgaatttact ggatgaagag gtatcatttg tatctaaatt
74341 ttatacacca cagctacaat taagtgaatt agcaaaaaaa gtattgacaa atataaagac
74401 agatgatata cctgtattag aaagagaatt taatgataat acaattatcc ataaagctaa
74461 cgatacatta ctaaaagtac aggctccaag aatgtatatg attctacagt cgattgtact
74521 tgaagcatat gctattgtta attgctttgt agaaaatccg agctctttaa aatacttaac
74581 tgaagaagat gttagtataa cacgggaaaa tttaaattat gtagctgact acttaggtaa
74641 ctatgatgac tataatagtg ttgtcttaga cttaagagat ttagacttat gttttagtgc
74701 tatagaatta caattacctc taatcaaaaa ggaggctaac gtataatgag attaagaag
74761 cacgtagttc aacatgaaga aacgatgcaa gcaatagcac agagatacta tggtgatgtg
74821 agttattgga tagacctagt agagcataat aatttaaagt acccctattt agtagaaact
74881 gatgaagaaa aaatgaaaga ccctgaacga ttggcttcta caggtgatac actgattata
74941 cctatagaat ctgatttaac agatgtatca gcaaaagaaa ttaattctag agataaagat
75001 gtactagttg aattagcttt aggaagagat ttaaatatta ctgcagatga aaagtatttt
75061 aatgaacatg gtactagtga taatatacta gcattcagca caaatggtaa tggagattta
75121 gatactgtaa aaggcataga taatatgaaa cagcaattac aggcacgttt attaactcct
75181 agaggttctt taatgctaca tcctaattac ggttcagatt tgcataattt atttggtctt
75241 aatatacctg aacaagctac attaatagaa atggaagtat tgagaacatt aacatcagat
75301 aatagagtaa aatctgctaa tctaattgat tggaaaattc aaggtaatgt ttattcaggt
75361 caattttcag tggaaataaa atctgttgaa gaatcaataa attttgtctt aggacaagat
75421 gaggaaggaa tttttgcttt attgaatag gaaaggatta aattatgaaa actagaaaat
75481 taactaacat actatcaaaa ttaatagata agacaatggc aggtacaagc aagataacag
75541 actttactcc tggttcagct tctcgttcat tattagaagc tgtatcatta gagatagagc
75601 aattctatat tctaacaaaa gaaaatattg attggggtat acaagaaggt atcattgaag
75661 cttttgattt tcaaaaaaga caatctaaaa gagcttatgg tgatgttact attcaattct
75721 accaaccctt agatatgaga atgtatatac ccgcaggaac aactttact tcaacacgac
75781 aagaataccc tcagcaattt gaaacattag ttgattatta tgcagagcct gattctactg
75841 agattgttgt tgaagttat tgtaaagaaa caggggttgc aggtaatgtt cctgaaggaa
75901 caattaatac tatagcatca ggttctagtt tgattagaag tgttaataac gagtatctt
75961 ttaatacagg aactaaagaa gagagccaag aagactttaa gcgcagattc cactcttttg
76021 tagaatctag aggtagagca actaataaat cagtaagata tggtgcactg cagatacctg
76081 atgtagaagg tgtttatgtt tatgaagaaa caggacatat tacagtattt gctcatgata
76141 gaaacggtaa tttatcagat accttaaaag aagatataat tgatgcttta caagactata
76201 gaccaagtgg tataatgtta gatgttacag gtgtagaaaa agaagaagtt aatgtttctg
76261 ctacagtaac tatatctaat aaatctagaa ttggtgatac attacaaaaa catatcgaaa
76321 gtgttattag aagctattta aataatttaa aaacttctga tgacctaata attacagacc
76381 ttattcaagc tataatgaat attgatgatg tattaatata tgatgtgtca tttgataacc
76441 tagatgagaa cattatagta ccgccacaag gaattattag agcaggagaa ataaaagtag
76501 aactaaagta aagagaggtg aaacttaagt cgtggctaat tttttaaaga atcttcatcc
76561 attattaaga agagatagaa ataaaaaaga taatcaagac cctaactttg ctctgataga
76621 tgcactcaat gaagagatga atcaagtaga gaaagatgct atagaaagta gttacaatc
76681 ttctctaaag acatctacca gtgaatattt agataagttt ggggattggt tcggagttta
76741 tcgtaagacc gatgagaaag atgatgttta tagagcaaga attataaaat atttactctt
76801 gaaaagagga actaataatg ctataataga tgctataaaa gattatttag gtagagatga
76861 tattgatgta agtgtatatg aaccttttac aaatattttc tatactaaca aatcacattt
76921 aaatggtgaa gaccacttaa tgggatacta ttatagattt gctgttatta atgtctctat
76981 aggtgattat ttccctgtag agattataga tgtaattaat gaattcaaac ctgcaggtgt

```
77041 aactctatat gtcacttatg atggggcttc tactattaga ggtggagcaa ttattaagtg
77101 gttagatggg ttacctaaaa tagaaacata ccaagagttt gatagattta caggttatga
77161 tgatacattc tatggtcata ttaatatgaa tcaaagtaaa gatactgata acagttcatc
77221 agatatttt aaaacaaacc atagcttaat taatagttta gatgttttaa caggttcatc
77281 tagtgtaggg agacagtata ttaactacgg atatgtaaca tcatatgttt ataatccagg
77341 tatgacatct tctgtaaatc aaataagcgc tagtacagaa ggtagaggtc aagaagtacc
77401 tactgactat tatatgtata ctagtactaa gaataacaat acagtagaac ttagtatgca
77461 aactacttcc ggtgtgtctt atttatataa taactttaat tttagggact atatgagtaa
77521 atatagacct caagtagatt tacaatctga tgaggctaga agaattgtat ctgattatat
77581 aaaagaatta agtattgatt actatcttag tgctgtgata cctcctgatg aaagtataga
77641 aattaaacta caagtttatg atttttctat taatagatgg cttacagtat caattaataa
77701 tttatctttc tatgaaaaaa atatcgggag caatatagga tatataaaag attatctaaa
77761 cagtgaatta aatatgtttta ctaggttaga gataaatgca ggtaaaagag attcagtaga
77821 tattaaagtt aattacttag atttaatgtt ttattactat gaacgaggta tttatacaat
77881 aaaaccgtat aaagcattaa tagaaaatta tttagatata tctagagaga cttatgtaga
77941 agcatttaaa atagcatcat tatctaatgg agatattata actaaaacag gttttcagcc
78001 tataggggtat ttaaaactag ttggtaatta tgaaaataca ataccctagca caataaaat
78061 agtagctaaa gatacagata ataaccctat agaatctaat gaattagatg tatataatac
78121 agtagagaat agaaatttat tacaatctta taaaggtgta aatacgatag ctagagaaat
78181 aacttctaca aaagagtttta ctgtatcagg atgggctaaa gagatatact caactaatta
78241 tcttttctaaa gtattaaaac caggtaaagt gtatacgtta tcttttgata tggaaataac
78301 aggtaatgac ccaactctta aatcttattc tgataatcat ggtatatatt tatacagtaa
78361 tactaaggga attgttgtta atggtgttaa atctatggaa cgtactatag gtaacaaagt
78421 atccgtaact caaactttta cagccccctac tattactgac catagattac taatatatac
78481 tggaagatat acatctgatg gtaaagcatc aactcctcca gtgttcttta atacagttaa
78541 aattacggaa ttaaaattga ctgagggttc ttctaagcta gagtactcac ctgctccgga
78601 agataaacct aacgtaatag aaaaaggaat taatttaat aatatcctaa ctaatataca
78661 gactttaagt attaattcgg atactatctt aaaaaatgta acttatatt attcttacta
78721 tggtgatagt tgggtagaac taaagactct aggaaatatt agtactggag aaacaacaga
78781 aaccaataac ttaatagatt tatatggatt acagacagta gattattcta atataaatcc
78841 aatgtctaaa gtatcattac gttccatttg gaatgttaag ctaggtgaat tgaacaatca
78901 agaaggttct ttatataata tgcctaatga ttactttaat gctgtatggc aggatatagta
78961 taaattatca gatattgagc taggttctat gagaatggtt aaagacactg agggcggagt
79021 attcgatgga gctacaggtg aaattattaa ggctactcta tttaatgtcg gtgcttatac
79081 tgatttagat atgttagcct atactttgac taattatact gaaccgttaa cgttaggctc
79141 tagtcgatta ataattgagc taaagaaga actactaaca tcagaatcat ttaatgtcga
79201 taatagaatt aaagtaattg actcaatata tgaggagtta ccaaatacaa gcattattaa
79261 aaatggattt gttgaaagag aagttacagg ttctaaatat ttagattacg gtttatatga
79321 gcctatagaa gatggtacta gatataaact tattgtcgaa ggagaattta aagataatat
79381 agaatttata tcttttataca attctaaccc taactttaat gaaacattta tatatccatc
79441 agagataatt aatggagttg ctgaaaaaga attttattgca aaaccatcta ctgaagacaa
79501 accaaggtta aatacagatg ttagaatata tatacgacct tatgattcaa ctatctctaa
79561 agtaagaaga gtagaattaa ggaaagttta ataaataagt tgacagaaag ttaataatat
79621 ggtatacta taagtaata tttagtggggt ataccatgtt atattaataa agaaaacaac
79681 agatgaaagg aattaaaaaa tatgcaatt gcaacgtata attctcatgt tgagttagca
79741 aaatatctag ttagtaaagc tgattcagtt tacttaacaa ttggaaagag cacaccgtgg
79801 tctaatgaaa caaacccacc gcaacctgat gaaaatgcaa cagtattaca ggaggttatt
79861 ggatataaaa agctactaa agttactta gttagacctt ctaaatcacc tgaagatgat
79921 aataagaatt taatttctta tggtaataaa tcgtgggtag aagtaacacc tgaaatgct
79981 aaagctgaag gagctaaatg ggtttactta gaaagtagta ttgttggtga cgaactacct
80041 cttggaacat atagacaagt aggatttgtt atggacttag tagcaaaaag tggtattagt
80101 aaatttaact tagtacctag tgaagtagaa tcaactggaa cattattatt ctttgataat
80161 aaacaattcc aaaatagaag tgacagaca actgctaaag aaagattat tgtagaagtt
80221 taaagaaagg gagataattc taaatggcaa ttaattttaa aggtcaccct tatttagata
80281 gatttgaccc gtctaaagat agaacaaaag tattatttaa tcctgataga cctctacaac
80341 aggcagaatt aaatgaaatg cagtctatag accaatatta tttaaaaaat ctaggagacg
```

Figure 15 (contd.)

```
80401 ctattttaa agacggagat aaacaatcag ggcttggatt cacattgtct gaagataatg
80461 tattgacagt aaatcctggt tatgtatata tcaatggtaa aataagatat tacgataatg
80521 acgattcagt taaaataact ggcgtaggta aagaaactat tggtattaaa ttaacagaac
80581 gtattgttac acctgatgaa gatgctagcc tattagacca aactagtgga gtaccaagtt
80641 acttctctaa aggtgcagat agattagaag aaaagatgtc attaacagtt aatgacccga
80701 catcagcaac tatttatact ttcatggatg gggatttata tattcaatca actaatgctg
80761 agatggataa aatcaacaaa gtattagctg aacgtactta tgatgagtca ggttcatata
80821 aagtaaatgg ttttgaacta ttttcagaag gtaatgctga agatgatgac cacgtttctg
80881 tagttgtaga tgcaggtaaa gcctatgtaa aaggttttaa agtagacaaa cccgtatcaa
80941 caagaattag tgtacctaaa tcttatgact taggaacagc agaaaatgaa agtactatct
81001 ttaataagtc taataactct attagtttag ctaatagccc tgtaaaagaa attagacgtg
81061 ttacaggtca agtacttatt gaaaaagaac gagttacaag aggagctcaa ggtgatggtc
81121 aagatttct ttcaaataat acagcatttg aaattgtaaa agtttggact gaaacaagcc
81181 ctggagttac tacaaaagag tataaacaag gagaagactt cagattaaca gatggtcaaa
81241 caattgattg gtcacctcaa ggtcaagaac cttcaggagg tacttcatac tacgtttctt
81301 ataaatataa caaacgtatg gaagccggta aggattatga agtaacaact caaggtgaag
81361 ggttaagtaa gaaatggtac attaactta cacctcaaa tggtgctaaa cctattgacc
81421 aaacagtagt attagtagac tatacttact acttggctcg taaagattca gtgtttatta
81481 ataagtatgg tgatatgca atattacctg gtgaacctaa tattatgaga ttagttacac
81541 caccattaaa cacagacct gagaattac aattaggtac agttacagta ttacctgatt
81601 cagatgaagc cgtatgtatt tcatttgcaa tcactagatt gtctatggaa gacttacaga
81661 aagttaaaac aagagtagat aactagagt ataaccaagc agtaaatgct ctagatgatg
81721 gtgctatgga aggacagaac cctctaacat tacgttcagt attcagtgaa ggtttcatta
81781 gtcttgacaa agcagacatt acacatcctg actcggaat tgtatttagt tttgaagatg
81841 cagaagctac tctagcttat acagaagcag ttaaccaacc taagattatt ccaggagata
81901 caacagctca tatttggggt agattaattt cagcaccatt tactgaggaa cgtacaatct
81961 accaaggtca agcatcagaa acattaaatg ttaaccctta taatattcct aacaaacaag
82021 gtgtgttaaa attaacacct agtgaggata actggattga tactgaaaat gttacaatca
82081 ctgaacaaaa aactaaaaag taactatgaa acgattttgg agacataatg aaagttacta
82141 tggtgagact gagcattact tgtattctaa cttacagtta gatgcaggac aaaagtggaa
82201 aggtgaaact tacgctatg atagagagca tggtcgtacc ggtacttat tggaatcagg
82261 aggacaacgt actctagaag aaatgattga attcattaga atcagagatg tatccttcga
82321 agttaaagga ctaaaccta atgataataa tttatattta ttattttgatg gagtaagatg
82381 tgctataaca cctgcaactg gctatagaaa aggctctgaa gatggtacga taatgacaga
82441 tgctaaagga acagctaaag gtaagtttac tattcctgca ggtattcgtt gtggtaaccg
82501 agaagttaca cttaagaatg ctaactctac aagtgctaca acttacacag cccaaggacg
82561 taaaaaacc tctcaagata ttattatcag aactcgtgta acagtaaact tagtagaccc
82621 gttagcacaa tcattccaat atgatgagaa tagaactata tcatcattag gattatactt
82681 tgcttctaaa ggtgataaac aatctaatgt tgttatccaa attagaggta tgggtgacca
82741 aggttatcct aataaaacaa tctatgcaga aacagttatg aatgctgatg atattaaagt
82801 atctaataat gctagtgctg aaactagagt atactttgat gaccctatga tggctgaagg
82861 cggtaaggag tacgctattg ttattattac tgagaacagt gattatacaa tgtgggtagg
82921 tactagaact aagcctaaaa ttgataaacc taatgaggtt atttcaggta atccatacct
82981 acaaggtgta ttattcagtt catcaaacgc atcaacatgg actcctcacc aaaactctga
83041 ccttaaattt ggtatttata cttctaaatt taatgagaca gcaacgattg aattcgaacc
83101 aattaaagat gtatcagcgg atagaatagt tcttatgtct acgtacttaa ctcctgagag
83161 aacaggatgt acgtgggaaa tgaattaat tctagatgat atggcatctt ctacaacatt
83221 cgaccaattg aaatgggagc ctatcggtaa ctatcaagac ttagatgttt taggtctagc
83281 aagacaagtt aagttaagag caacttcga atctaataga tatatctcac cattaatgag
83341 ctctagtgat ttaacattca ctacattctt aacagagtta acaggtcat atgttggtag
83401 agctattgat atgacagagg ctccttacaa tacagtaaga tttagttatg aagctttctt
83461 acctaaaggt actaaagttg ttcctaagta ttctgcggat gatggaaaaa cttggaaaac
83521 atttactaaa tcccctacaa ctactagagc caataatgag tttacacgct atgtcattga
83581 cgagaaagta aaatcatcag gaacaaatac taaactacaa gttagattag attatcaac
83641 tgaaaatagc tttttacgtc ctcgtgttcg tagacttatg gttactacta gggatgaata
83701 aactagaggg gttgattgac ccctcttat ttaataagga gagatttata tgcctagaga
```

```
83761 agttagagac ccttattctc aagctaaatt atttatacct acagttgagg aaaaatcaat
83821 taaggaatta gaaaaaacat acaaagaaaa aattgatgaa gctactaagt taatcaatga
83881 attaaagaaa gagagaggag aaaaatagat ggcatttaac tacacgcctc ttactgaaac
83941 acagaagtta aaagatatgt atcctaaagt taatgatata ggtaactttt taaaaacaga
84001 agttaaccti agtgatgtaa aacagatatc acaacccgac tttaataata tttagcatc
84061 tatacctgat agtggtaact attatgtaac taattcaaaa ggtgctccta gtggagaagc
84121 tacagcagga tttgtaagat tggataaaag aaatgtaaat tattataaaa tttactattc
84181 accatatagc agtaacaaaa tgtatatcaa gacttatgct aatggtactg tatatgattg
84241 gattagtttt aaattagatg aaggtagctt atacaatgaa ggtaatactt tgaatgtaaa
84301 ggaacttact gaatccacaa ctcaatatgc aacactagtt aatcctccaa aagagaactt
84361 aaatacaggt tgggttaatt acaaagaaag taaaaatggt gtttcttctt tagtagaatt
84421 taacccggtt aactccactt caactttaa gatgataaga aagttaccag tacaagaaca
84481 aaagcctaac ttattgaaag atagtttatt tgtttatcct gaaactagct attctaatat
84541 taaaacagat aactgggata cgcctccatt ttggggatat tcttctaata gtggtcgttc
84601 aggagttaga tttagaggag agaatacagt acagatagat gatgggtctg atacgtaccc
84661 ttcagtagtt tctaataggt ttaaaatggg taaagaactt tctgtaggtg atactgtaac
84721 ggtatcagta tatgctaaaa ttaatgaccc tgctttactt aaagataact tagtttactt
84781 tgaattagca ggatacgata ctgtagatga tactagtaaa aatccttata caggaggacg
84841 tagagaaata acagcaagtg agataacaac tgagtggaaa aaatactctt tcacattcac
84901 tatacctgaa aatacaatcg gagcatcagg cgttaaagtt aattacgtat ctttactact
84961 aagaatgaat tgttcatcta gtaaaggtaa tggtgctgta gtatactatg ccttacctaa
85021 attagaaaaa tcatctaaag ttacaccatt tattacacat gaaaatgatg ttcgtaaata
85081 tgatgagatt tggtctaatt ggcaagaatt tattagtaaa gatgaattaa aaggtcactc
85141 ccctgtagat attgaatata atgattattt taaatatcag tggtggaaat ctgaagttaa
85201 tgaaaagagt ttaaaagatt tagctatgac agtacctcaa ggatatcata cattttattg
85261 tcaaggctct attgccggga cgcctaaggg acgttctatt agaggaacca ttcaggtaga
85321 ttatgacaaa ggtgacccat atagagctaa taagttttgtt aaattattgt ttactgacac
85381 agagggtatt ccttacacat tatattatgg tggttataac cagggttgga aacccttaaa
85441 gcaatcagaa acttctactt tactatgaa aggtagttta gattttgggt ctacggaagc
85501 tgttaactta aatgactcat tagataatta cgattaatt gaggtaactt attggactcg
85556 ttcagcagga catttttcta caaaaagatt agatataaaa aatacatcaa atttactgta
85621 tattagagat tttaatattt caaatgatag tacaggttct agtgtagact ttttttgaagg
85681 gtattgcact tttcctacta gaacatcagt acaacctggt atggtaaaat ctatatctttt
85741 agacgggtct acaaatacaa caaaagtagc atcatggaat gaaaaggaac gtataaaggt
85801 atacaatatt atgggaatta ataagaggata aagaaaggtg gaataaaaaa actatggctg
85861 ttaaatatga tataggtaat aatgagatag tattacattt aagagaaggt aaatatataa
85921 cagggtttac aacagtagga gggtatgata aggagttagg acaagtaaaa gttaatagag
85981 aaatcttacc tgcttacttc tttgataatt ttgcctatga aagatatttg tattatagta
86041 aacctgaaga ggttagagaa aataaaaact atgtaccacc acaaatcaat gatgatgatg
86101 aggaatccca acaaattact gtacctaaag aacaatatga tagtttaaaa gaagaactag
86161 agcttatgag aaaacaacaa gaagctatga tggaaatgct tcaaaagctc ttaggtcaaa
86221 aggggtaatt ataaatggca ttaaatttta ctacaataac ggaaaacaat gttattagag
86281 acctgactac tcaggtcaat aacattggag aagaattaac aaaagaaaga aatatatttg
86341 acattaccga tgattagtt tataattta ataatcaca gaaaattaaa ctaactgatg
86401 ataaaggatt aactaaatct tatggaaaca taacagccct tagagatata aaagaacctg
86461 gttattacta tataggtgct agaacattag caacattatt agatagacct gatatggaat
86521 ctcttgatgt tgttttacat gtagtacctc ttgatacttc tagtaaggta gttcaacatt
86581 tatatacact atctactaac aataaccaaa ttaaaatgtt atatagattt gtctcaggaa
86641 actctagttc agaatggcaa tttattcaag gattacctag taataaaaat gctgttatat
86701 caggaactaa tatttagat atagcttcac caggtgttta ctttgttatg ggaatgacag
86761 gaggaatgcc tagtggagta agctccggat ttttagactt aagtgtagat gctaatgata
86821 atagattagc tagactaact gatgctgaaa ccggtaaaga atatactagc attaagaaac
86881 ctacaggaac atacacagcc tggaaaaaag aatttgagcc aaaagatatg gagaaatatc
86941 tactaagtag tattagagac gatggtagtg catcattccc actcctagtt tatactagtg
87001 atagtaaaac atttcaacaa gctattatag accatatagg tagaacaggt caaacaacct
87061 ttactttcta tgttcaaggc ggtgtatccg gttccctat gtcgaatagt tgtcgagggt
```

Figure 15 (contd.)

```
87121 tattcatgtc agacacacct aatacttcta gtttacatgg tgtttacaat gctataggta
87181 cagatggtag aaatgtaaca ggttcagtgg taggtagtaa ttggacttca ccaaaaacat
87241 ccccttctca taaagaatta tggacaggag cacaatcatt cttatctaca ggaactacta
87301 agaatttatc agatgatatt agtaactact cttatgtaga agtttatact acacataaga
87361 caacagagaa gactaaaggt aatgacaata caggaactat atgtcataag tttfatttag
87421 atggtagtgg aacttacgtt tgttcaggta catttgtttc cggggataga accgatacaa
87481 aacccccctat cacggagttt tatagagtag gtgtatcttt taaaggttct acatggactc
87541 ttgtagatag tgcagtacaa aatagtaaaa ctcaatacgt tacaagaatt ataggtatta
87601 atatgccata gactaggaga aatttcctag tctttttttt tcttgacttg aaaaggattc
87661 tgtggtatac tataactcgt gtaaggatat aaggagatta aaatgagatt aagaattaag
87721 aacttatata cctatgtaga atttgaggag gatgataaat acttaaaaga tatattttta
87781 aagagagtcc atacgactat aggagcaaga caagaaggat ttcagtacag ccctgcgtac
87841 aaaagaggta gttgggatgg ttatgtagat tttatgttt atgaggaaga taaattcccc
87901 actggacttt tatttaaaat tgagttatta ttaggtgagc tacaatcaag gtataatttc
87961 cagtttgaaa caattgatga gcgtgatgaa agtttcttat ctgaagaaga tattgatgat
88021 gagataacat tgcttgataa taatgtcggt caaattacct taagagatta ccaatatgaa
88081 gcagtgtaca atagcttaac attttacaat ggtattgctc acttagctac taatggtggt
88141 aaaactgagg ttgctagtgg tattatagac caattattac ctcaattaga aaaaggtgag
88201 agagtagcat tcttcacagg ctctacggag atattccatc agtctgcaga taggctccaa
88261 gagcgtttaa atattcctat tggtaaagta ggtgcaggta agtttgatgt taagcaggtt
88321 acagttgtaa tgatacctac tttaaatgca aaccttaaag acccaacaca aggggtaaag
88381 gttacgccta aacaaaatat tagtaaaaag attgctcaag agatattacc taaatttgaa
88441 ggtggaacaa atcaaaagaa attactaaaa gtattacttg ataacacaac acctaaaaca
88501 aaagtagaac aaaatgtatt aagtgcctta gagataattt accaaaatag taagacagat
88561 gcagaagttt tattaaactt aagaaatcat aatgcacatt ttcaaaaaat tgttagagaa
88621 aagaacgaaa agaaatatga taaatatcaa gatatgagag atttttaga ctcagttaca
88681 gttatgatag ttgatgaggc acaccattct aaatctgatt cttggtacaa taatttaatg
88741 acatgtgaaa aagctttata tcgaattgca ttaacagggt ctatagataa aaaagatgaa
88801 ttactttgga tgagattgca ggcgctattc ggtaatgtta ttgcacgaac tactaataag
88861 ttttttaattg atgaaggtca ttctgctaga ccaacaataa atattatacc tgtagctaat
88921 cctaatgaca tagatagaat tgatgattat agggaagctt acgataaagg tataacaaat
88981 aatgatttta ggaataaact tattgcaaaa ctaacagaaa agtggtataa tcaagataaa
89041 ggtacattga ttattgtaaa cttcattgaa catggagaca caatatcaga aatgtaaaat
89101 gatttagatg tagagcatta cttcttacat ggagaaatag actctgaaac taggagagaa
89161 aaatttaaacg atatgagaag tggtaagctt aaagtaatga tagctacatc acttattgat
89221 gagggtgtag atatatcagg tattaatgca ctaatattag gtgcaggagg taagtcatta
89281 agacaaacat tgcaacgtat tggtcgtgct ttacgtaaga aaaaagacga taatacaaca
89341 caaatatttg attttaatga tatgacaaat agattttat atactcatgc taatgagcgt
89401 aggaaaaatt atgaagagga agattttgaa ataaaagact taggaaaata ggagggtaag
89461 agatggcaac aaaaacacaa agaaagctat accaatatct agaggaaaat gctacagaaa
89521 ataaatttca tatttctact aagaaagagc tagcagattc tctaggtgtt tccatctctg
89581 ctttatccaa taaccttaaa aagttagaag aagaaaataa agtcgttact gtttctaaaa
89641 gaggaaaaaa cggcggggta ataataactt tagttagaga gtatgacaca gaagaattga
89701 aagaattcaa taattctaca gataatatta ttacttccga tttacagtat gctaaggcat
89761 taagagaaaa gcacttccct tcttatagat atgagagaaa agaacaacgt agacgtacta
89821 agatagaaat ggcacaaatac aatgccatta aggatgagaa gagaagaatt atagcagata
89881 tgaatttcta ttcagaaggt cttccttatc cttctaaaga tatttttaat atgtcctatg
89941 acccggaagg gttttataaa gcgtacatct tatgtaagtt atacgaccaa tatgctattt
90001 ctcatatgga tgctaaacat acaagtcatc ttaaagcaat gagtaaggca acaactaaag
90061 atgaatacga ctaccatcaa catatgtctg aatactatag aaataaatg attcaaaatt
90121 tacctagaaa tagcgttagt gataattct ttggtagtaa aatgtttaat acttttata
90181 attttattt aaaaataaaa gataaaaata ttaatgtatt taagtatatg caaaatgtat
90241 ttaaaaatgt aacatttat tacgagaacg gtatgcaacc taatccaata cctctcccta
90301 acttctttag ctcagataag tattttaaaa actataataa ttatattaaa ggaataaaaa
90361 aaggtgttaa cagtactaat agacacctag gtgatacaga cagcatcatt aattcatcag
90421 actatgtgaa aaaccctgct gtattacatc tacaccaact atatactaca ggattaaatt
```

```
90481 ctactttaca tgatattgat actatgtttg aacaagcctt agaccttgaa aatgcctcct
90541 atggattatt tggagatatg aaacatatta ttttactaca gtataattct atgattgaag
90601 aagaaattaa gaatttaccct agagaagaaa aggatattat taataaatat gtaaaacaat
90661 gcataattaa tgattattca ccaacaagta tttcaccttc tgcaaggtta tcaatgttta
90721 ctatgcagaa agagccatata gtttacaata agcagttaaa taaaggaatc aagagagagg
90781 attattacc attaagtcta ggaggtatag tgaataaaga tttattgagt ggtatggata
90841 tacaaaactt agaacagaat ggtaatgaat acctatatat gagacaacat acttcaactt
90901 attatatatt aagaatgttt ggtgactatt tagggtatga ggtaaactta agagaagtaa
90961 aatatattgt agagaaatat aatttaattg ataaaatacc attgacaaaa gagggtatgt
91021 tggattataa taaacttata catttagtag aggaagaggt taataactat gagtaagaag
91081 ataaaggagc ttatccttca taaatcaatg aaggatatac attttgcaag agaagtatta
91141 gataacttac ctaagaatct attttcagca gagtctgagg acatgggtta cttattaca
91201 gctataaaga aacagcaca tatttccgat aagatgtcaa atgaagcatt agcaattaaa
91261 gtagaacagc ttatgggtaa taataaggaa gatgaagaga aagtaaccaa gacattaact
91321 tacttagaag atttatataa agtagacgtt aatgaaaaag atgaatctgt taattatgaa
91381 atagagaagt atattaaaac agaaatgtca aaagaagttt tagttaaatt tattgcagaa
91441 aataaacaag aagactctga taatctacat gaacttgtag acaaactaaa gcaaatagaa
91501 gtaagtgaca tctcaggagg taatggggag tttattgact tcttcgaaga tacagaaaag
91561 aaacaagaac tattgagtaa tttagctaca aataaatcct ctactggatt tacttctatt
91621 gacaaccata ttgaaggtgg tatagcaaga ggagaggttg gattaatcat agctcctacc
91681 ggtagaggta aatcattaat ggcttcaaac ttagctaaga attatgttaa aagtggatta
91741 agtgttttat atattgcctt agaggaaaaa atggatagaa tggttttgcg tgctgagcaa
91801 caaatggcag gagcagaaaa gagtcaaatt gtaaatcagg atatgtcttt aaataataaa
91861 gtttatgatg caatacaaaa tcattatcag aagaatagaa agttattagg tgactttat
91921 atttctaaac atatgccagg tgaagttaca ccaaaccaat tagaacaaat tattgtcaat
91981 acaacaatta agaaggataa aaatattgat gttgttatta ttgactatcc tcacttaatg
92041 agaaatcctt atgctaaata tcattcagaa tcagatgcag gagggaaatt gtttgaagat
92101 attcgtagat tatcacagca atatggattt gtttgttgga cgttagctca aactaaccgt
92161 ggtgcttatg gttcagatgt tattacaagt gagcatgtag aaggttctcg taagattgtc
92221 aatgctgttg aggtgtcttt agcagtaaac caaaaagatg aagaattcaa gagcggtttc
92281 ttaagattgt atttagataa aattcgtaat agctctaaca caggagaacg atttgttaat
92341 cttaaagtag aaccaactaa gatgattgta agagatgaaa cacctgaaga aaaacaagag
92401 catatacaat tgctatcaga taatggaaaa gaagacacaa gtaaatttca aaataaagat
92461 aataaaaatag aagctataaa taacacattc ggaggattac cgggagttta atttttaaa
92521 atatacaact tgacatttta tatgttaggt ggtataatta tttataaag aataaaggag
92581 agattaataa tgaaatttgt attctttaca gatagccact ttcacttatt tactaactat
92641 gctaaacctg atgagcagta tgtgaatgat agatttagag aacagataca agctttacag
92701 aaaatgtttg atattgcaag agaagaggat gcaacagtta tatttggtgg ggatttaatc
92761 cacaaacgta acgcagtaga tactagagta tataataagg tatttgaaac attccaactt
92821 aatagagata tagaagtact aatgttaaga ggtaatcatg attcagttac aaatagttta
92881 tatacagatt ctagtataga acctttcggt tacttaccta atgtagaggt ttgtaaaaac
92941 cttgatactt tagggttttt aggagaagaa caggatatta atattgttat ggctccttat
93001 ggagacgaga ctgaagaaat taaagagttt attaaaaata aatatgtaga agatagagta
93061 aatatcttag taggtcattt aggtgtagaa ggctctttga ctggaaaagg gtctcataga
93121 ttagaagggg catttggata ccaggattta ttacctgata aaatatgattt cattttacta
93181 ggtcattatc accgtagaca atatttccaa aatccgaatc attttatgg tggttcatta
93241 atgcaacaat catttctga tgagcaagaa gctaatggtg ttcatttaat agatacagaa
93301 aaaatgacta cagaattcat cccaatccat acacgtagat ttattactat tcaaggagaa
93361 gatattcctg agaacttga acagctaatc gaggaagata attttattag ggttatcggt
93421 acagcaaatc atgctaaggt tttagaaatg gatgacagta tgaaagataa gaatgttgaa
93481 gttcaaatta aaaagagta tactgtagag aaacgtattg atagtgatgt gtctgatgac
93541 cctttaacaa ttgctagtac ctatgctaaa caatactcac ctgaatcaga acaagaaata
93601 cttgagtgtt tgaaggaggt tttataatga aaaatatag aatatctca aataagacag
93661 atgcagaaaa tttagcagag gattgggaga aagtaaccga agatttatgg aaagtgttta
93721 aagatatgaa acctaaaatt aatacattag atatcagtaa tgtagtaagt aaagacttag
93781 ataaaagtaa acctattta caattccaag attcagatgg agtaatagag aatatttgta
```

```
93841 atgttgaagg tttagaagat ggtctaagta aaatgaaaaa gattttgat gatagtaatt
93901 ttgaaaagca ttattacaat agagtagtag accatgatga gtattactgg attgattatg
93961 gctctcatca ttgtttcttt agagttacga aaggggataa gtaatggttg tatttaaaca
94021 agtagaagtt aataatttt tagcaattaa agaagctacg ctagagttag acaatagagg
94081 attaattcta attgaaggtg agaataaatc taatgagtca tttcattcaa acggctcagg
94141 aaaatcaact ttaatatctg ccattactta cgctttatat ggtaaaactg aaaaaggact
94201 aaaagcagat gatgtagtaa ataatattga gaagaaaaat acatctgtta aacttaagtt
94261 tgatattggg gaagatagtt atttaattga acgttatcgt aaagataaag agaataagaa
94321 taaagtaaaa ttattcgtta atgaaaaaga gattacaggt tcaacaaatg acgttaccga
94381 taaacaaata caagatttat ttggtattga gttaatact tacgttaatg ccatcatgta
94441 tggtcaagga gatatcccta tgttctctca agcaacagat aaaggtaaga aagaaattct
94501 tgaatctatt actaagacag acgtatataa acaagcacaa gatgtagcaa aagagaaagt
94561 taaagaagtg gaagaacaac aaaataacat aagacaggaa atctataaac taggttatca
94621 gttatcgaca aaagatgagt actttcaaag agaaatagag cagtacaatc aatataaaga
94681 acattggtt cagatagaaa acagtaataa ggaaaaagat agattaagag aacaagagga
94741 gaagcaaata gaagctcaaa tagagcaact agcttcacag ataccaacaa tacctgaaga
94801 tgaatttaag cactcagagg agtataataa agcctctcaa agcctagatt tactttctaa
94861 taaattaacg gagttaaatc aagtttactc agagtataat accaaagaac aagtactaaa
94921 atctgaaata gctacattaa gcaatagtct aaatcagtta gatacaaatg accattgtcc
94981 tgtttgtggc tcccctatag ataattctca taaattaaaa gaacaggaaa atatcaataa
95041 tcagattgag aataagaaac aagagattac tagtgtatta gaaatgaaag atacgtataa
95101 agaagctatt gataaagtaa aagataaatc acaagaaatt aaagataaaa tgtcacagga
95161 agaccaacaa gaacgagagc acaataataa gattaacagc ataattcaag aggcttctag
95221 gattaaatca gacattagtt cattagagaa taataaaacg tatttaaaag ttaaatatca
95281 acatcaatct gttcaaggat tagagagaga agaaccaagt aaagaaaaac atgaggaaga
95341 taagaaagaa ttcaagaaat ctattgacaa acatgaaagg aatatagtac aattagaaac
95401 taagaaaggt aaatatcagc aagctgtaga tgcttttagt aataaaggta tacgttcagt
95461 agtgttagac tttattacac cattcttaaa tgaaaaagca aatgagtacc ttcaaacttt
95521 atcaggttca gatattgaaa tagagttcca aactcaagtg aagaatgcta aaggagaact
95581 aaaagataag tttgatgtta ttgttaagaa tagcaagggc ggaggttcgt acaaatccaa
95641 ttcagcagga gaacaaaaac gtattgattt agcaattagt tttgcaattc aggatttaat
95701 tatgagtaaa gatgagatat ctacgaatat tgcactttac gatgagtgtt ttgatggatt
95761 agatactatc ggttgtgaaa acgtgattaa attattaaaa gatagactta atacagtagg
95821 aacaatattt gtaattactc ataataccga gcttaaacca ctgtttgaac aaacaattaa
95881 aatcgtaaaa gaaaatgtag tatcaaaact ggaggaaaaa taatgaaatt aaagatttta
95941 gataaagata atgcaacact taatgtgttt catcgtaata aggagcacaa aacaatagat
96001 aatgtaccaa ctgctaactt agttgattgg tacectctaa gtaatgctta tgagtacaag
96061 ttaagtagaa acgggggaata cttagaatta aaaagattac gttctacttt accttcatct
96121 tatggttttag atgataataa ccaagatatt attagagata ataaccatag atgtaaaata
96181 ggttattggt acaaccctgc agtacgcaaa gataatttaa agattataga gaaagctaaa
96241 caatatggat tacctattat aacagaagaa tatgatgcta atactgtaga gcaaggattt
96301 agagatattg gagttatatt ccaaagtctt aaaactattg ttgttactag atacctagaa
96361 ggtaaaacag aagaagaatt aagaatattt aacatgaaat cagaagagtc acaactgaat
96421 gaagcactta aagagagtga tttttctgta gatttaactt atagtgactt aggacaaatt
96481 tataatatgt tgttattaat gaaaaaaatt agtaaatagt aaggaaggat attatgaggt
96541 ttgaagactt tttaacccaa gaattaggag aaccaaaaga aaatactata ggtgagctaa
96601 gatactgttg tccgttttgt ggagaaaaaa gttataagtt ctatgttaag caagccctag
96661 actctagtaa tggtcagtat cattgtaaaa aatgtgatga atcaggtaac cctattacat
96721 ttatgaagac ttattataac attacaggta acaagcttt tgatttatta gagtctaaga
96781 atatagatat agagagagcc cctttactta cgaccaataa taaggatttg acagaatcag
96841 agaaacttat attaatgcttt agaggtgtgc accaagataa aggaaatact agtattaaac
96901 ctcctagatt acctgaaggg tataaattat taaagataa cttaaataat aaagagatta
96961 taccctttt aaaatactta aaaggtagag gtataacttt agaacaaatc attaataaca
97021 atatagggtta tgttattaat gggagcttttt ataaagttga cggggaatcc aaagtatcat
97081 taaggaaatag tattatattt tttacttatg ataatgatgg aaactaccag tactggaata
97141 caagaagtat agagaagaac ccttatatta aatctattaa tgctcctgct aaacaagatg
```

Figure 15 (contd.)

```
97201 aagtagggag aaaagatgtc atatttaatt tgaatatagc aagaaagaaa aagttcttag
97261 ttataactga gggtgtattt gatgctttaa ccttccatga gtatggagta gcaacattag
97321 gtaaacaagt aaccgagaat caaataaaaa aaataattga ttatgttagt atagatacat
97381 caatatatat tatgttagac actgatgcac tagataataa tatagactta gcttataagt
97441 taaaaacaca ttttaataaa gtttactttg tacctcatgg tgatgaagat gcaaatgata
97501 tggggacaag gaaagccttt gagttattaa aacagaaccg ggtgttagta acacctgaaa
97561 gtatacagag ttacaaaata caacaaaaac ttaaacttta ggcttgacct tagagaagtt
97621 ttatgttata ctagtaatta agtaattaat aaaggagaaa aaaaataatg tcaaataata
97681 aaaaagatat tttagaattt gtagatgaat acattacagc tttaagagtt ggtaatgagc
97741 aacgacaaca tcaattagaa gaaatgggta aagaagaaac agcaacatta acagatgtag
97801 ctaaagctat tactaacctt atgttaggtg ttaatgagca gatgacagac ttagaatata
97861 ataatgagtt aaacttaaat atttaattg acgctttata taaagcagag cttattaatg
97921 aagatgtatt agactacatt caagaatcaa ttgataaatc acaagaagaa cctaaaaatg
97981 aagaagaaaa aggagaacaa gaataatgga aaaaaatatt agcacacaca caaaaggtat
98041 tagtcaagca gacatggaga aatgattga agctgyagta caaggaactg ttgatggtaa
98101 acaagttgat gagaaaacag ctaaacaatt akatagaatt ggttcacgta gtgtttcttt
98161 agaagaagca actcgtattg ctaaagttct taatgctgta acagctcaag aggttacagg
98221 agactttaat gatgcattta atgcaattga cttaatgatg attatcatgg aagatgagtt
98281 aggagtaact caagaaaaag tagggaaagc taaagataaa ctaaatgaaa aacgagaagc
98341 ttacctaaaa gagaaacaag aagaattacg tcaaaaacaa caagaagagg cacagaaaaa
98401 aactgaatct gacagcaatg aaaaagtaat tcagttgaag aaaaatgacg aacagtaaga
98461 aaaaagggga tacattcgaa cgtaaaatag ctaaagaatt aacttcttgg tggggataac
98521 aattcaatag gtctcctcaa tcaggtggtg cttcatgggg taaagataat aatgctgtcg
98581 gagatatagt agtacctcag gaagctaatt ttcctttagt agtagaatgt aaacatagag
98641 aagaatggac tatagataat gttcttctaa acaacagaga gccacataca tggtgggagc
98701 aagtcattaa tgatagtagc aaggtgaata agacaccttg cttaatattt actagaaata
98761 gagctcagag ttatgttgct ttaccttatg atgaaaaagt atatgaagat ttaagaaata
98821 atgaatacce tgtcatgaga acagatttta ttattgataa tattagaaaa gataaatttt
98881 ttttatgatgt cctataact accatgaatg ggttgacctc atttacacct tcttatatta
98941 tatcttgcta cgacaaaaaa gatataaaac catacaagaa ggtcgagtct aatttatctg
99001 aggtaagtaa gcatgaagat gaattgatta atgaccttct tagtgatata taaggaaggt
99061 aagataagta tgacaagtaa agaaagacca ttaatcgtat atttttcagg tacaggacaa
99121 acagaaagat tagtaaacaa aattaatatt aataattcat ttgaaacatt tagggttaag
99181 agtggaaaag aaaaagtaaa taaaccttt atactaataa cacctactta taagaaaggt
99241 gcaataccta aacaaataga aagattccta gaaattaatg ggagccctaa agaagttatt
99301 ggtacaggaa ataaacaatg gggctctaat ttctgtggag caagtaaaaa gatttcagag
99361 atgtttaaga ttccttaat tgctaaagta gagcaatcag gacactttaa cgagatacaa
99421 ccaatattag aacactttag taataaatat aaagtagcgt aaaggatgag agatatatgg
99481 caacatatgg aaaatggatt gagttaaaata atgaaataac tcaattagat gacaatggaa
99541 aaaataaact ctataaagac caagaagctt tagatgagta tttaaaatat attgaagaca
99601 atacaagaaa gtttaatagt gaagtagaaa gaattagagt attgacaaaa gaaggaacat
99661 atgataaaat atttgacaas gttcctgaca ctattatga tgaaatgact aagtagctt
99721 acagttttaa ttttaaattc cctagtttca tggcagggca aaagttat gaatcttacg
99781 catcaaaaca gtatgatgaa aacaaaaaac ctatttttgt tgaagactat gaacaacata
99841 atgttcgagt agctttatat ttatttcaaa atgactatgt aaaggctaga gaattactag
99901 tacaacttat ggagcaaaca ttccaaccat ctacacctac gtataacaac tcaggacaag
99961 ctaatagagg tgaactaagc tcatgttatc tatttgtagt agatgattca attgagtctt
100021 taaactttgt tgaagatagt gtagctaatg ctagttctaa tggtggtgga gttgcaattg
100081 atttaactag aattagacct aaaggagctc cagtacgtaa tagacctaat tcaagtaaag
100141 gtgttattgc ttttgctaaa gctattgaac ataaagttag tatttatgac cagggtggtg
100201 taagacaggg tagtggtgct gtttacctaa atatattcca caatgatatc ttggatttat
100261 taagctctaa gaaaatcaat gccagtgagt ctgttagact agataaatta tctatggtg
100321 ttacaatccc taacaaattt atggagttag ttaaagagg taaacctttc tatactttg
100381 atacttacga cattaataaa rtgtacggta agtatttaga tgagctaaac attgatgaat
100441 ggtatgataa gttactarat aatgatagta tcggtaaagt aaaacatgat gctagagaag
100501 ttatgacaga yattgctaaa acacaattag aatcaggcta cccttatgta ttctatattg
```

Figure 15 (contd.)

```
100561 ataatgctaa tgataatcac ccattgaaaa acctaggtaa agttaaaatg agtaacttat
100621 gtacagaaat ttcacaatta caagaggtat cagaaattta tccgtattct tacagtaatc
100681 agaatgttat taatagagat gttgtttgca cattaggttc tcttaacttg gttaatgtag
100741 ttgaaaaagg tttattgaat gaatctgtag atattggtac aagagcatta acaaaagtta
100801 ctgatattat ggatttacct tacttaccta gtgttcaaaa agcaaatgat gatattagag
100861 ctatcggttt aggttcaatg aatttacatg gactttagc taagaatatg attagttatg
100921 gttctagaga agcattagac ctagtaaaca gtttatatag tgctattaac ttccaatcta
100981 ttaagacatc tatgttaatg gctaaagaaa caggaaaacc atttaaaggc tttgagaagt
101041 ccgattacgc tacaggtgaa tactttgtaa gatacattag agaatccaat caacctaaga
101101 cagataaagc taagaaagtc ttagataagg tttatattcc aacacaagat gattgggatg
101161 aattagctaa agcagtgaaa gtacatggtt tgtataatgg ttaccgaaaa gcagaagcac
101221 ctactcaatc tatatcttat gtacagaatg ctacaagttc tattatgcca gtacctagtg
101281 ctatagagaa tagacaaatt ggagatatgg agacatatta cccaatgcct tacctaagtc
101341 ctataactca gttcttctac gaaggagaaa cagcttataa gattgacaat aaacgtatta
101401 ttaatacaag cgcagttgtt cagaaacata cagaccaagc agtgtctaca atactttatg
101461 tagagtcaga aatacctact aataaactag tatcattata ctattatgct tgggaacaag
101521 gattaaaatc attatactat acacgttcac gtaaactttc tgttattgaa tgtgaaacat
101581 gttcggttta gaaaggaaat agatatggat attacacaaa aagtaaaaca acataataaa
101641 aatgctgtat taaaagcaac aaactggaat attgaagatg acgggatgtc tgatatttat
101701 tgggagcaag gaatctccca attttggact cctgaagagt ttgatgtatc aagagattta
101761 agttcttgga atagtttaac tgaaagtgaa aagaacactt ataagaaagt ccttgcaggg
101821 ctcacagggc tcgatacaaa gcaaggagga gaaggtatga acttagtatc ctaccacgaa
101881 ccaagaccta aataccaagc tgtatttgcg tttatgggtg gtatggaaga gatacatgct
101941 aaatcgtata gtcatatctt tacaacatta ctaagtaata aagaaacaag ttatttatta
102001 gatacttggg tagaagaaaa cgactttta aaagtaaaag ctcagtttat cggatattac
102061 tacgaccaac tattaaaacc taatcctact atatttgata gatacatggc taaagtagct
102121 agtgcctttt tagaaagtgc attattctac tcaggatttt attatccttt acttcttgca
102181 ggaagaggtc agatgacaca atcaggagct attatttata aaattactca agatgaagct
102241 taccatggtt cggcagtagg attaacagct caatatgatt ataatcttct aacagaagaa
102301 gagaaaaaac aagcagataa agaaacttat gaattattag atattcttta cactaatgaa
102361 gtagcgtata cacatagtct atatgaccca ctagaattaa gtgaagacgt aattaactat
102421 gttcagtata attttaatag agctcttcaa aaccttggaa gagaggacta ttttaatcct
102481 gaacctata accctattgt agaaaatcaa actaatgtag acagattacg aaatgttgat
102541 ttctttagtg gtaaagcaga ctatgaaaaa tctacaaata tcaaagatat taaagatgaa
102601 gatttctcat tcttagatag taaagaatac agtactgcca aggaattcct ataaaaagga
102661 gaaaagatat tatggataga aaagaagcaa tggatttact aagtaaagca gaaatattat
102721 ttaaaaaaca tgatgagttt tcatgtgtaa gtgatatcaa tgaccctatg aagttattca
102781 gtaactctaa agatgctaaa gctgatgata cgtctaaktc ttttcagcta gagtttatgc
102841 atgatatgac catgtatact ttatcttatg gctcaggaca gctaaaactt attgatttag
102901 cagaaggtta tgaagcacaa aaagctacar tagttaactc atttcccgaa attattaaaa
102961 cattagaaaa ggatgattca gaagatggaa aaaatgaata gtttagtaga tttaaataca
103021 gcaattagac aaaagaaaga tgttattgtc atgattcac aagataattg tggtaagtgt
103081 gagatttaa aaagtgtaat ccctatgttt caagagtcag gtgacattaa aaaacctatc
103141 ttaacattaa atctagatgc tgaagatgta gatagagaaa aagctgttaa gttattcgat
103201 atcatgagta caccagtatt aattgggtat aaagatggtc agttagttaa aaagtatgaa
103261 gaccaagtta cacctatgca attacaagaa ttagagtcac tttaatttgg aatttcctac
103321 tatctgtgct atactataat agtacaaggt agtaggattt tttaatggaa ggaagatgac
103381 atatcgcaaa gaataaaaca ttaacgatat ataatagtga tagatatttt aatatacaca
103441 caaaagataa agataaaatt aatgaggcta ttaaagtaac acacggtaat gaagaagaaa
103501 ttgaaaagaa tatggataaa ttaatatcta gtctagaag atatatcatg agggatgaaa
103561 agcattacat gctatttaat gagaagtaca ataatgatag gcttatagaa aaagtatgta
103621 aacacggtgg taaagttaca tactatactg attcagtatt accttactat gttttaaaag
103681 acttatctag tcaccctgac tcagaagttg tttatcgtat gcgcaacggt ttactgcaa
103741 aagaagtaga taatatagct ttatcattca tgggtacaaa agttattatt gatatttctg
103801 tagtatttcc ttatgtaaac ccttatgata ttattagaag tttacatgat attaaaacaa
103861 atgtagatga agttcatta tcatttccac gaatattagg ggtagatgaa aaacaagaaa
```

```
103921 agtttlattt ctttgatggt gaagcttatg atttaaaacc cgaatataaa gtcgattttg
103981 cagataaaat tagagtatct ttatcagtat ggaaaatgta tatctatatc ttaacaagta
104041 gtcgtgattt tgaggatgta gacaatgtaa ttacgaaatt aaaacaacaa cgaaagatta
104101 agataaagg tgattatatg agtacagcaa atagaagaga tatagcaaga aagatatcag
104161 agaatacagg ttactatatc caagatgtag aggaaatact aagtgcagag acagatgcta
104221 tttctgactt gctagaagaa gggtatacta aagtaaagaa tcataaattt atgcaaatag
104281 aagttattga aagaaaaggt aaaaaagcgt gggatggtct gaataaagaa tacttccatt
104341 tacctaatag aaaagctata aaattcaaac cactaaaaga actagaagag gttattgata
104401 gacttaatga agaagagaaa taattctctt cttttttat tgacaaggtt taaaatatat
104461 ggtatagtat tattaagtta aaaaaggaga ggaattaaat gaaagtatta atcttatttg
104521 accacattag agaagagcat ttttctgtaa gtaaagatgg gagtgtgaaa tctaatgtac
104581 taaatacacc taacggaaaa acacttaaga aattacttga gaagtgttct aacttaaaga
104641 gagataaaac aaacagagat tatgatattg atttctcta caatgcagta cctacaccta
104701 ttagaaatga ctacggtaaa atcattaaat accaagatgt taaacaagca gaagtaaagc
104761 catactatga gagaatgaat aatattatta ttgataattc ttatgatatg gtaattcctg
104821 taggtaaact aggtgttaaa tacctattaa atgttacagc tattggtaaa gtaagaggtg
104881 taccaagtaa agtaactatt gaaaatggaa catcttctca tgatgtgtgg gtattaccta
104941 cttatagcat tgaatatact aatgtaaata aaaatagtga acgtcatgta gtatcagatt
105001 tacaaacagt tggtaagttt gtagagcaag gagaagaggc atttaaacct aaggaagtat
105061 cttacgagtt ggtagataac attgaaagag taagagaaat attcaataag gaagtaaaga
105121 atgataatta tgatggggta gatattaccg catgggactt agagactaac tcattaaaac
105181 ctgataaaga aggaagtaaa cctttagtac tatctctatc atgagaaat ggtcaaggtg
105241 taactatacc cttatacaaa tcagacttta actgggaaaa cggtcaagat gatattgatg
105301 aagtcttaga attgcttaag aattggttag ctagtaaaga agatattaaa gtagcacata
105361 acggtaaatg atttgctgtt gtaaaatccc tctcatatcg ggcatagctt taagtagctg
105421 ataagagaac ctaagtcctg taataaggat agtggtaatc ccgagcttac attattggtg
105481 acaatagatg gggtgtagag actgagccga ggttttgtag accaaggtga gacatagtgt
105541 atcgacttaa tagaggtggt acagtgaaaa aagattatat gacatcagtt aaaaataaca
105601 aaaaagtatg tagaagatgc aacgaagaat tagatttatc taactttaaa acatataaga
105661 agaatgataa aacttattat caaagtatgt gtataccttg tcggaaggaa tataataagt
105721 tagataaaac taaaaatact attaaaaaat gttatgagaa aaacggagat aaatatagaa
105781 gacaaagtaa tgagtataat actcttgaca gaggtagaga gcttaataaa aataggtcta
105841 ggaaatacag agaaaacaat tctttaaaat cgaaagctag aagctctgta agaaccgcat
105901 taagaaatgt ttctctcata agacctgata agtgttcaga gtgtaataaa gattgcatac
105961 ctgaagctca ccatcctgat tatactaaac ctttagaaat aaaatggtta tgtaaatcct
106021 gtcatgaaga tactcatcat aaaaaataat cacactatgt aaatgaggga catcaagccc
106081 atttaggtaa ctacaaacaa acctaatggt aagggcttat gaaggtatag tccgttctat
106141 atagaaatat ataggctaaa acgaaatatg atattaagtt cttaatgagt actgaaaact
106201 ttaaagattt tgagagtatt caggatacta aagtaggttg gtacctagct gttacccaag
106261 aagttaaaga atcttaaaga ttatctgatt tagcttatga ggttacagat gtcggaggct
106321 atgataaacc attagaagac tttaaattat ggttgttac taagttatta agattcttct
106381 cagataaaat taagagata cagaagaaa ataaaaagat tgctaagaaa gagtatgatg
106441 ttaaagctcc tgaatataaa gaatggttag agaataaatt aaatgaaaca gtagtagaac
106501 tagatgatac tgagaaaaaa tttagagtta gtgaattaga gaaaaagtat attcaactag
106561 gtctttcacc tgaaattgta aatatgaatt tagttatgga taatgatgaa ttcataaata
106621 ttgcagaaca atcacctgag tacatggggt tatctgacta cgctaagtct tacacgttaa
106681 atactgcaat taattaatt aatgagtata gagatgtaaa agatgtagtt aatgatattg
106741 acggaggtaa ctttaattat gattggttcc ctattgagtt aatgcatcca tacgcatcag
106801 gatatactga tgtatgtaga agaattcatt gtgatgtaat taagaaactt aaagaacaag
106861 atagacctaa gtcaatgcat ttattagaag ttaattaccc aagcttact aagtctttag
106921 ctagaattga atcaaatggt ttatattgtg acttagatta tatgaaagaa aatgatgagt
106981 catacgagtc tgagatggct aagaaccatg ctacaatgag agagcactgg gctgttaaag
107041 aatttgaaga ataccaatac aatctttacc aaatggcgtt agaagaacat gagaaaaagc
107101 caaaagatat agataaagat atccatcagt acagagataa atttaaagat ggtaaatgga
107161 tgttttcccc aagttccgga gaccataaag gtagagtaat ttatgatatt ctaggaattc
107221 aattaccta tgataaagaa tatgtcaagg aaaaaccatt taatgctaat gttaaagaag
```

```
107281 cagaccttac ttggcaggac tataaaacag acaagaaagc tattggttat gcgttagata
107341 atttagaatt aaaagatgat gttaaagagc ttcttgaatt acttaaatat catgctagta
107401 tgcagacaaa acgtaattca tttactaaga aattacttaa tatgattaat aaacaaaaac
107461 gaacattaca tggttctttt tctgagacag gcacagagac atcaagacta agtagtagta
107521 acccttaaat tggggttgta aaactttgtt aactgcggga agagactcgt taggtcttaa
107581 ctactaactt ataatggaaa catatataag ggcaaacagt aacgtgtttg atatagtaaa
107641 aaggttaaga atagagagaa tccgcatcca agaccctgaa agtatataaa agtatgggta
107701 aggttcaacg actaggtgtt gagacaatac aatcaataca cacccacgaa agcaaaggta
107761 ttatttctgt ggtagggaat aataaggaga gttatatgaa agagatttgg aagaaagtag
107821 taggattga aaactacgag gtaagtaata aaggaaaagt aaggaatata aaaactaact
107881 atatttaaa gccgtggata ataaaattccg gatatgagca agtatctata ggtattgcta
107941 atgtattagt acatagatta gtggctatga catttatacc taccgacagc tatagtatag
108001 ttaaccatat tgataataat aaattaaata actgtgttga aaatttagaa tgggtaagtt
108061 acaaaggtaa tagtgctcac gctaataagc aaggaagatt gaatacttat agtgcaagag
108121 aaaaacttag ttctgtatct aagaaagcca tttatcaaaa agatatggaa ggtaacatca
108181 ttaagttatg ggattcacca agtgaagctg aaaaagaatc taatgggtac ttaaaagta
108241 ctaagattag ttccgttgct cacggtaaac gtaagcatca tagaagttat acttgggaat
108301 acgtatataa ggattcaaag agaagtttaa ataagtctat taatatgtat gatttaaata
108361 ataatttatt atatgaagat ttgacaatga ataaaattat gggtatacta gaaatgaata
108421 atcataaaac attaagagat aaactaagaa atacagatga ctttgttgaa tacagaggat
108481 ataaatttaa aaataataat taaaacctac cacagaaatg atatatgata tagtctactc
108541 aatagtgaga gctattgtgt tacctaaaca gtaacagatt gtaaactaaa aagcttacaa
108601 attatagaat ttacaaaact tacctgcaca cacatcagat gtaaataagt ttgattacaa
108661 acatccaatt aaacgttcat ttgtttctag atttgaaaat ggagtactgc tagggtccga
108721 ctatagcgcc ctagagatgc gtatatcgg attatttact aaagaccctg atatgctaca
108781 atcattctta aatggggaag atatccataa ggctactgca agtattgttt acaataaacc
108841 agtagaagaa gtaactaaag aagaacgaca agcaactaaa gcagttaact tcggattagc
108901 ctttggtgaa tcacccttct catttgcagg taaaaataat atggaagtaa gtgaagcaga
108961 agaaatattt gaaaagtatt tccaaacaaa accaagtgta aaaacttcta ttgacaatgt
109021 acatgagttt gtgcaacaat atggttatgt tgatacaatg cacggacata gaagatttat
109081 ccgttcagcc caatcaacag ataaaaagat aaaaaatgaa ggtctaagac agtcatttaa
109141 cactatcatc caaggttcag gtagtttctt aacaaacatg tctttaactt acttagatga
109201 ttttattcaa tctcgtaatt taaaatcaaa agttattgcc acagtacatg atagtatctt
109261 aattgattgt cctcctgaag aagctaaaat tatggctaaa gtgacaattc atattatgga
109321 aaacttacca tttgatttct taaaagcaga aattgatgga aaagaagtac aatatcctat
109381 tgaagccgat atggaaattg ggttaaacta taatgatatg gttgaatatg atgaggaaga
109441 aatagataca tttaattctt accaaggtta tattaagtat atgatgaatt tacagaccct
109501 agaagattat aaagagtcag gtaaactaac agatgaacaa tttgaaaagg ctactaatgt
109561 tgttaaaagt gaaaaacata tttatcaaga aattaataa aagtattgac aatatagtta
109621 acttatgtta tactatataa gtaataaata taaggaggaa aaagagtgaa tacaggggag
109681 attagattta atcgttctat ggatgaatgg attataacaa gcatgtacca ggatgagcta
109741 ggtgggatga atattgttgt tacattctat aatagagaag aaaataaaca tggttctaca
109801 gttttaccaa cagagtcatc tactggagaa gtaacagagg aattggcaag tcttgaagaa
109861 gaatatcctt tagcttacc tttaagtagt atctcagtta atatttaaaa ggaggaactg
109921 ataaatggaa atacacattg attccctaga ttttacaaac tttactatta aagatagaaa
109981 tgggaactca caagagtttg atatttacaga tgagttaaga attacagagt atacaataca
110041 agaggatttt atgcaacaat cagctaaata tgcttttttgg gcttctatat tagagaaggt
110101 aagagcatat tctgaaatgg aacaaagaaa cctagaaaca attggtagta agctaaacct
110161 tacaattaga caagagtacg aacaacaagg taaaaagcct actaaagata tgattgaatc
110221 tagtgtttat attcacgatt cttatcaaca acaacttaaa gttgttgagg cttggaatta
110281 taagttaaa caacttcaat atgttgtaaa agcttttgag acaagaagag atatgatgat
110341 tcaattaggt gcagaattac gacaaacaaa taaaaatggt ggaattacta atccattttc
110401 acattaaaaa ataaagtaaa gaatataatt gacaaatata aaaaactatg ttataataaa
110461 taagtaaatt aattaaaagg agaaaagata attatggatt tcaatcaatt tattaacaat
110521 gaggcaagca aattagaaag caataacagt tcttttaaca ataatgtaga gagctacaaa
110581 cctaaaaacc ctgtactacg tttaggtaat attaaagatg caaacggaaa taaggttgtt
```

```
110641 aaagaaaatg cttttgtacg agtattacct cctgcacaag gaacaaatgt tttctttaaa
110701 gaatttagaa caacaggtat taactattct aagaaagatg gttctcaggg attcacaggg
110761 ttaacattac ctgcagaaga gggttcatct gtccttgacc catacattca ggattggata
110821 acaaatggtg ttcagttcag tagattccct aataaaccag gagtacgcta ttacattcat
110881 gttattgaat actttaataa caatggtcaa attcaaccaa aaacggatgc tcaaggaaat
110941 gtaatgattc aacctatgga attatctaat acaggatata aagaattatt agctaactta
111001 aaagacacta tgttaaaacc atcacctaat gcacctcata gctttatctc agcaactgaa
111061 gcattcctag ttaatattgt taaagctaag aaaggtgaaa tgtcatggaa agtaagtgtt
111121 tatcctaatg cccctttagg tgcgttacct caaggttggg aacaacaatt atctgactta
111181 gaccaattag caaaaccaac agaagaacaa aatcctaatt ttgttaactt cttaatcaat
111241 aacgttaata acacagagtt aagtcatgat aactttaaat ttaaccgtga aacaaatgtc
111301 ttaggtgaag aaccttcaga gcctaaacaa gcacccacac aacaagatgt agatagtcaa
111361 atgccaagta atatgggagg acaacctaat cagcctcagc aaggtcaagt aggtcagtat
111421 gcacaacaag gtcaaagtaa tggtcaagga cagcagttac aaggtacaca acaacctatc
111481 aataacactc aatttggtca aggaactcct tcaggacaac aaccaagtaa cacaggttct
111541 gttgattggg ataacttagc gcaacaacaa tcacaacctg attcaaaccc attcaatgat
111601 tttgatgtta gcagtgttga tgattcacag gtaccttttg agacacaacc tcaaaataca
111661 caacaagcac ctgaaccaca acaaactaca caagagcctc caaaacaaaa acaaacgcaa
111721 agtattgacg atgtattagg tggtctagac ttagataacc tataagatat agagtgcctt
111781 agagcactct tttatttgag atataattac taggaggata ttaaatggca agagcaaaaa
111841 aaggtaaaga agtcgattta acagatttaa atacaattga tttaggtaaa gaattaggat
111901 taacattgct atcagataca aacagagcag atattaaaaa cgttatacct acaatggttc
111961 ctcagtatga ctatatttta ggtggaggta ttccattagg tcggttaaca gaagtttacg
112021 gtttaactgg cagtggtaaa tctactttg cagttcactt atctcgaatt gcaacacaat
112081 taggtgttat cactatttgg attgatattg aaggaacagc agataacaat cgtatggagc
112141 aacttggtgt agatgtttca aaactattct ctattcaatc aggagaaggt agacttaaaa
112201 atacagtaga attatctgta gagcaagtag gtaaagaatt agagtactgg attgacactt
112261 tcaatgaaaa gattccggga gtacctattg tatttatttg ggactcatta ggggctacaa
112321 gaactcagaa agagattgat ggcggtattg atgagaagca aatgggtctt aaggcatcag
112381 ctacccaaaa agtaattaat gcagtaacac ctaaactaaa tgatacaaac acagggttaa
112441 ttgttattaa ccaagcccgt gatgatatga atgcaggtat gtatggtgac cctattaaat
112501 ctacaggtgg tagagctttt gaacatagtg ctagtttacg tattaaggtt cataaagcat
112561 ctcagttaaa acagaaaagt gagttaactg gtaaagatga ataccatggt cacattatgc
112621 gtattgaaac taagaaaatct aaactatcac gaccagggca aaaagctgaa gcagacttac
112681 tatctgatta tatggtaggt aaagaagatg accctatctt attaaatggt atcgacttag
112741 aacatactgt atataaagaa gcagttgaaa gaggtttaat taccaaagga gcatggagaa
112801 actatgttac attgaatggt gaagaaatta aacttagaga tgctgaatgg gttcctgtac
112861 ttaaagataa taaagagtta tatctagaat tgtttagtag agtttatgga gaacacttcc
112921 ctaatggtta ctcaccatta cttaataaca aagtaatcgt aactcaatta gaagagtatc
112981 aagctcttga aaactactat aaagaatggg ctacagataa taaacaagag gaacaagagg
113041 aagaactaaa aggagaatct caagaaaagg attctgaata atagatggat aattaatag
113101 ataaaaacat gaatcaggta aaagaatctt tggggaatgc aaattcctca gatgttcttc
113161 ctttaccta taaagatata gcaaagaaat ttgaagaagt aaaagaaaaa ggtgaatcaa
113221 ttatcattga agaaggtgga ttcccttata cagattctac agtgatgtat atagaacatg
113281 taacagatag atgggcagga ggatattcct taattagaca tgaaggtgaa gaagttaaag
113341 tacctaagac tatccatttc tctgatatat atgttaaaga taaatcacac aaagtaagaa
113401 taatcttcga gggggctaat ccttatgaag aaagctaata atggtaatag atatgtaata
113461 gatatagatg gtataccctgt tgattttgaa agggatttag atagtttact taataggtat
113521 aaaaacctta gatggtcgtt atatcatagg tacgcaggga ttttatctaa tgatttgaa
113581 agacaagaac taagagaata tattgatgag caatttatta aattagttaa agaatataat
113641 attagaagta aagtggattt tcctggatat attaaagcta aactaactt aagagttcaa
113701 aatagttatg ttaagaagaa tgaaaaatat aaacgtactg aaattatcgg taaaaaagat
113761 tatacagtag agtcttttaac agaagattta aatgaagact tcgaggataa tcaaattatg
113821 agttatgtat ttgatgatat agaattaca gaggttcaaa gtgagttact taaagaatta
113881 cttattaacc ctgaaagaga agatgatgcc ttttatcgttt ctcaagtagc ggaaaagttt
113941 gatatgaaaa gaaaagaagt agcaagtgag ttgacagaac tcagagacta tgttagattt
```

Figure 15 (contd.)

```
114001 aaaataaatg cataccatga gtactatgct aagaaagaat taaataacca tagagttaat
114061 actgaaaatc atatttggga aaactagtta cagtgccttc cttgtgttat attattatcg
114121 agaattcaat aataaagcat agggaaggct tttttctatg tcttatagaa tgctttaaaa
114181 tagattacta aaataaagat tggagattaa gcttatggct aaaaagaatg ttaatgatgt
114241 attacaacaa gaatctgtta cagtagcaga taagtattta caagttaaag ttaaccgtga
114301 cggttatact cgtacacatg aaggacaata tgcgtacaaa gtagtttcag agggagaaga
114361 attattctta taccctgtac aaacagatgg taaaggtaca ttaaatgtaa tgaagaaatc
114421 acctattgct tacactgatg gagacaatat ccatttcgta gtaaacacag tagtagaccc
114481 ttataatcac tcatttatcc gtactgaaga tattaaagga ttagataaag gtaaacaact
114541 tattcaagct ttcttagctt tcgttgaaga ccgtttcaaa tttggtgttt ataacgtatt
114601 tgttgcaaac aacaaagagg atgtattatc tattgtagac cctacagata atgatgcaga
114661 tgaagttaaa gatagtttag agcacgcaca tgaagatgta attgcggatt tccctgctag
114721 ccctgctcgt aaggacgtta aaggcgtaga ttcaggagaa ggtcaaggag acacttcaga
114781 accatcagca cctaagaacg ttcaagttac tcctaaggaa gacggagcag acgtatcagc
114841 agaataatat atagataagg atggtaaatt tggctaagtt aaatttatac aaaggtaatg
114901 agttactaaa cagcgtagaa aaaacagaag gaaaatcaac aatcacgatt gagaatttag
114961 atgctaatac ggattamcct aaaggtactt ttaaagtatc attctcaaat gattcaggag
115021 agtcagagaa ggtcgatgtt cctcagttta agacaaaagc aattaaagtt atttcagtta
115081 cccttgacgt tgatagttta gaccttacag ttggagatac tcaccaacta tcaacaacta
115141 tcacgcctag tgaagcatct aacaaaaatg tgtcatttga atcagacaaa tcaggtgttg
115201 ctagcgtaac atcagaaggc ttaattgaag cagttagtgc aggaacagct aatgttactg
115261 taactactga agatggtagt cacactgata ttgttgctgt aacagttaag gaacctattc
115321 ctgaagcacc tgcagacgta acagttgaac ctggtgaaaa tagcgcagat attactgtat
115381 aggaggacaa taaagaatgg aaaagacatt aaaagtttat agtaatggtg aagtgtggg
115441 ctctcaagta gctaataacg atggagctac tacagtatct attacaggct tagaagccgg
115501 aaaaacttat gctaaaggag attttaaagt agcatttgct aatgattcag gtgaatcaga
115561 aaaagtagat gttcctgaat ttacaactaa aactcctact gaagaaccttcaggagacgc
115621 ataataatta agaccaacta aaaagttggt ctttttttat tgacaattta taatatctat
115681 gatacactat ataagaatta agaaaaggag gggaaagtaa tggatattcc aacaatatta
115741 tttagaaatc catatgatta tacgaaagta aaaaaattaa tggaaaacaa agagcagtat
115801 attgtagtaa agtttgattc tgtttctgtt cataatttaa atgttcaagg tatgatgaat
115861 gtcatccaag attacctaca catctatggt tacagagtta aagagtacgg acaagaaaat
115921 tcttctaaag atgatgaaag agacgttaaa ggctacttat atgaaagagt aggtgagtag
115981 ggtatgggaa ttatagtaaa ctccaaccat attcaatcag acactttata tgagtatgat
116041 agcttttttg atattgagaa agtagataca tttgaagaag gattgctttc aatacaggat
116101 gagccaactg ttttagcagg attcatctat gatgatatca catttaataa ggtcattaat
116161 tctaattcag atattgatga ttatattaag aataatgata tttattatgt ctctgatata
116221 ggattacttc ctgatacttt tatcactgtt gattctgata gaaaatatta ttcattatta
116281 caacagataa ctgagttaag taaagaccct tttcctaaat gggtagagga tgatgcaaaa
116341 ggtttaacta agtattataa ctttcaagat tttgaagatg tatttgattt aaatagtttt
116401 tacaaaaaag aagttgacat ggtaagagaa aagtgctata ataatggtaa tgtatattta
116461 ttatatgagg ttctgcctga ttataaatta cctctagctt atagtttact ttcaaacaag
116521 gagcatggta ttgttattat cggttcacag acacgttcta ataatgatat actgactttt
116581 tatgttaaag gtatggatgc taaggcaata gctagtatgt tcaatgtaga acatgattat
116641 gattctaata ttttccatac atttgtaaac agtcacatta atatttagg aaatcaaata
116701 actaagttta taagagagaa aggaagcagt tatgagtaac tataaaacaa tagaagaagt
116761 acaagcagtt attattgggg tattatttaa agatgaaggt aaaattgtaa catctaagtt
116821 taataaaatt actaaagagt ttggtttaga tagaatcggt aaagatgacc ttaaagaaat
116881 tgtagaggat attagacaag acgcttatct aaatgaactt aaaaacaaag caattaaagg
116941 taaagtaacg ttaggtgatt taaaagatgt tgcagataac caagtattcg aaggtaataa
117001 ctaccatgaa gaagtatcta cttatgtagt agctaaagaa aaagaattgt ctcacttaag
117061 agaacagcgt aagcacaata ggcatactgc atacccctcaa atatgtttg atgaacttaa
117121 agaacatatg gttaaggaat tacaaggga aacattagta gaacatcacg gaagtaaagc
117181 taatattaat gatacagagc taattgtgtt actatcagat ttccatattg gaagtatgt
117241 atctgatatg actaatggta aatatgattt tgaagttctt aaatcaagat taaatcattt
117301 tattaataca acagttaaag aaattgaaga tagggaaatt tctaatgtaa ctgtttactt
```

Figure 15 (contd.)

```
117361 tgttggggac ttagtagaac atattaatat gagagatgtt aaccaagcat ttgaaacaga
117421 gtttacttta gcagaacaaa tctctaaagg tactcgatta cttattgata tcctaaatgt
117481 actatctaat gtagtttcag gagaactaag atttggtatt attggtggta accatgaccg
117541 tatgcaaggt aacaagaatc agaagattta taatgataac attgcttatg tagtgttaga
117601 ttctttattg ttattccaag aacaagggct attaaatggt gtagatatta ttgataatcg
117661 tgaagatatt tatactatta gagatacctt tggcggtaaa tctattatca ttaaccacgg
117721 agatgggtta aaaggtaaag gtaatcatat caataaattt atcttagata gtcatattga
117781 cttattaatt acaggtcatg tacatcattt ctcagtaaaa caagaagatt ttaatagaat
117841 gcacatcgta gcttcatctc cgatgggata taataactat gctaaagagt tacatttatc
117901 aaaaactaaa ccttcacagc agttattatt tgtaaataag gaaaataaag atattgatat
117961 taaaacagta tttttagatt aaggatggtt aataaatgga tacaattttt attataggtg
118021 tagcgtttat aactttgca acatttaaca tagtctttag attatttgat ttatggacta
118081 cagagaaaaa aatggtaagt caaggacaac ctccactaag taactttgag tactatcatg
118141 tgatagtacc ttacttagta ggtgttattg ttattatact gagtattatt tttagggatt
118201 cctttgtattc cgcacaatca gggttcggtg ttattattac aagcttatt tacatgctag
118261 tttatgttat aattggtctt gtagggtcat ttgtacttac aatattccaa gctagaaaag
118321 ctagacagta tcaaacacag gaggataata atgaagttca atgatatta tgagcaatta
118381 attaaaaatg atacagtaca aaacattcat gagtctcaag atgacaaagg aaatatttat
118441 acaatacagt ttgataaagg taatgataag tatttattta atgttattaa tgatggattc
118501 ttgaaagaaa tgacaaatgg tatggtagac catcctgaag gtcagccata ttcagtaagt
118561 ttaatcaata aagaaacacc tagtatgtca gtgaaacaat atttaacaga tgtagaagat
118621 attgtaccta ctattagaaa aatggaaaag gattttcttat agagtcaagt cttttacttga
118681 ctctttttac tatatatggt atattaatat agaggtgact taaaaatgga tttaattt
118741 agtgcttttg ataatagctc attagcaatg agaattagtg agggtgtata ctatttcaat
118801 gatacgcctt attactttat tgagcatgta gaagaagaaa tgtctgagta tgttattgta
118861 tatgacatac atgacagaga ggaaaaagaa aatcctcaga agaaatatag aatagaacct
118921 taccaacgta caataccggg aggaacaccct cttagtaatt taattaagag tatgatgcct
118981 caacgtaagt atcctaagaa ggttacagaa gaccctatat ttgtagctaa tgtattttcct
119041 ttaggaacag atacagtaac aggtaaaacc ggtaaaggat tttttgaaag agataaggat
119101 agaactatct attctcaaaa ggaaccaact aaagtcgttc atggtcaata cacaggtgtt
119161 tttataggtc taacaagtgt taagtggaat agaacatata cccccttaga aagtgttgtt
119221 gagtactaca aaagggttaa aggagatagg ttaaatgtct aatgatgtag ttaagttcta
119281 tgaaaaagat attaaagacc ttatcagaac taaaaaacac atgttcaaag acgatgaaat
119341 aactagtgat ataaacgata tacgaatctt caatgagaaa gtcatttgtc aaggtaaatg
119401 tagaacagat tgtttagtgt tagaccgtaa tggtacagta atgggtatag agataaaaac
119461 agaacgagac tctacacaaa gattaaataa ccaattaaaa tattatagtc tagtatgtaa
119521 gtatgtatat gtaatgtgcc atgacaaaca tgtacctaaa gtagaacaaa tacttaaaag
119581 gtacaaacat aatcatgtag gtataatgag ttacattagt tttaaaggca aacctgttgt
119641 aggtaaatac aaagatgcta caccatcacc acatagaagc ccttatcata caatgaatat
119701 attatggaag acaaacttaa tgacaatact tagattgatt agagaccctc atacgtatag
119761 aacagggtat agctataatg ctagtggtag atatagtgga ggggaaggta atttctccca
119821 aacaactcaa agtaaaagaa tgaaaaaacc tgctattatt aaccaaataa ttcattatgt
119881 aggggtagat aatacttata aactctttac aagaggtgtt atctatgtt ataataatag
119941 gtgggaagtt atagaagaag atttctttaa tactatgaag aatggggtaa gagtaattaa
120001 tgagcaaaga caaaccaaat agacgtaaag agatacagca tcaacctgtt aactttgccc
120061 ctacgaatac tttaacagga gctaataata gtttctttgc taaaaagcct tcagagccta
120121 aagatgcaac atctgttatt gaatatcgta tactatttat taaagagattt gataacgtaa
120181 caagtacaga tgtgaaatta cagaaaaagt atgcactaaa tcttattagt gaagcacttg
120241 atgttaaaga aacttacttg tctcttaagc aaaaaggaaa aaaaacagaa tctatttgc
120301 atacagatag agtttattat gttcatagag gtaaaaaact tattggaaag tgtagtatca
120361 gagaacaaag aacatttaag ggtaaacatt tgatatttat attcaaaaca agacatagag
120421 ttaaagcaga aaggaaagat aaataatgtt aaaaggattt tcagaacatg tagacaaacc
120481 tacaactatt aagaccttat acaagaccttt aacaagtggt aaagtagaat tactaggtgt
120541 atcttacgat agtgattact tcccttcagg tgttacagta caatcttaca ttgaggatat
120601 aggtaatgaa gatgagggtc tacagttttgt taataaggta aatgtagtag aatcaatgaa
120661 acaggctgta gtaggtatga ataatcaatt aggttcttca ggtcttggct atgtgagaac
```

```
120721 tgaacaactt aaaaaagagt tggaagagac tggactaatg acagatttac ttgctagagg
120781 tactaactta acctctacta agaaagtaga tattgtaagt acttttattg agcctgaggt
120841 aacataccaa aatattacta tagctaaaga tattaaacta cgtttgtata aagtagaaga
120901 agaatcacca ttaaatggtt acactcatat tgtatactta cttactacag aaaaactata
120961 tgatggtcaa acactcttcg gtatgctctc taaaaaagat aagttatcta aaggagatac
121021 tgataaatta ttagcattct tcagaaacaa tagtttaata agtaaaagtg tattttgtgt
121081 taagttatta agtaaagact actactttaa tttatataat acacatgaga cagggatatt
121141 cttttagaa gacacagatg ttattactat tgcttgtggt cagtcatatg ttaaagttaa
121201 cactaaagat attaagtcta gttatgttaa aattgaagat aagactcata aattaactga
121261 gctagtaatt aacctaaagg gtgacgacac attaactatt ttattctagg aaaatgttat
121321 aaatatgtga taattaagta taaatatacg ttatataaga agttttcata atgtttttaa
121381 tacagaaact agttaagttt tttctacttg ctctagtttc tgtgaaatta tatttatgaa
121441 aagttaaaat atcttttagg taaaggcttt gtaaatagtt aaaaaatata ttaaaatttt
121501 atacaaagta gttaataaaa ttatatatca tttatatatt atgaaataat aacagaaatt
121561 gtgatatatt atatagtgta accttgaaac agttgatgtt gtagggtttg tttatgttcg
121621 ttaaactggt ttcagaaacat cagttaccat aaataaatga cagttaagga gagctatata
121681 atggctagaa aaaagaattt aagaaataaa aacagtgata taaaagttgt tcctgataaa
121741 gaaaaagaaa gtatattatc taagttatac cataataagt tactacgttc aaaggtagat
121801 aatgcattag atgaagatat gagttatgat gatattatag aattatgtaa agaatatgat
121861 ttagaattgt ctaaatcagc tattacaaga tataaaagta aaagaaaaga agctattgaa
121921 aatggttggg atttaggaga attaattgat aaacgtaaaa aaacaagtgt aaaagatatt
121981 aaggaaaaag aaactcctat attagaagag gagcaacttt ctccattcga acaatcaaaa
122041 catcacacac aaaacaattta tgatgatatt caagtactag atatgattat ttctaaaggt
122101 gcaaaaggat tagagtttgt ggaaacttta gaccctgctt taatgatacg tgcaatggaa
122161 actaaagata agattaccgg aaatcaatta aaaggtatgt catttattgg acttagagaa
122221 ttacaattaa aacaaacagc tcaagataca gctatgagtg aagtattatt agaattata
122281 cctgaagaga aacatgaaga ggtattacaa cgattagaag aactacaaaa tgaattctac
122341 aaaaatctag atttagatga ggaaagtaga aaattaaaag aagctcttga tagagtaggc
122401 tatacaattt agatagtgag gttagagtaa tggcagatga gattagttta aatccaatac
122461 aagatgctaa gccaattgac gatatagtag atatcatgac atacttaaaa aacgggaaag
122521 tactgagagt taaacaagac aaccaaggag atatccttgt tagaatgagt ccagggaaac
122581 acaaatttac tgaagtatct agagacttag ataaagaatc attctactat aaaaaggcatt
122641 gggttctcta taatgtatct gttaactctc ttataacatt tgatgtttat ctagatgaag
122701 aatattcaga aacaactaag gttaagtatc ctaaagatac tattgtagaa tatacaagag
122761 aagaccaaga aaaagatgtt gctatgatta aagaaatact tacagataat aatggtaatt
122821 atttctatgc acttataggg gaaacaatgc tctttgatga aaataaatta aataaagtta
122881 aagattaggg ttgacagctc ctatagttta tgatatagta tatgtatact aaaagtaaag
122941 gagctaacaa ttatgtttat ttcattaaat caagaagaga aagaattatt aactaaagag
123001 gaaagtaaat acacaccatt agaaacatca agagagttta acacacctaa agaagaattc
123061 attgtaacaa gctataatga aggtaaacct ttagattaca ttgcaaaaga agctaaggta
123121 agtatgggat taatttacac agttctaaac tactataaag taggtaagcg taataagaaa
123181 tcacctgtag aagaaagaat tgcacatatc ttaaagata aaaacttagt caaagagatt
123241 attaaggatt accaatatat gaattacag gacatttata gtaaatataa tcttcataag
123301 aatggtttat attacatctt agatttatac catgtggaga gaaaatctga acttaaggac
123361 aaagcattag aagaggataa tattgtcgtt gagtaagtaa agaggttata atatgagaaa
123421 taaaaaatca tttcaagagc agttaaatga catgcgtaat aaagagaaat gggtatctga
123481 agaggagttc actgaagaag tggctcctcc tgaagaacct gaagtagaag aagaaaaact
123541 atatactta aatgagttaa aagagagctt actagatgct caaggattaa aagatgttgt
123601 agctgatttt cctgcatcta aagatttata tgaacctaat aagttatata tctgtacaat
123661 acctaaagga tatcagtcta ccgaagtaca accaggacaa tatattggta ttagtactgg
123721 attattatca gagtcagaag acttcagcca tttaagaggt caaatgccta gaaacttata
123781 tgaaacttct catgttttaa aaacctttgat acgtattaat aatacaaata ttgaatacca
123841 acaacatgag ttacttgaag acattaagga tgacaaaaag atatatgatg tagagttaga
123901 agacttaaga ttagcaacag gagaagaagt ttctcattta gaaattgttg ataataagtt
123961 ttttgaaagt cgtattaatg aagttcttga ccgatacact gaactaacgg attccaatga
124021 tttacttaag tactatagta aattacgaga attagtaggt agtgacaaaa tgatttattg
```

Figure 15 (contd.)

```
124081 ttcactcctc gataaatgtg ttaaaattat agattaatag tagtctcctc ttatattata
124141 attgtaagag gggacatttt tgtatagagg tgttaattat gtcaagaaaa gcaagtatat
124201 tctatatact agtggttatt gttttggctt tctctatctc atcttattat atatcttctt
124261 tcatgtatca cgacaaagca aaaaatgaag tctctactga gttatcgaac acaggaaaga
124321 ttaaagaaga aaagaacgta gaatttgtcg gtgactacac attgaaaaaa gtggaagata
124381 ataaagctta ttttatggaa acattaccta cttacctacc aggtagaaca ggagataaca
124441 gcatagatat gaggtactac aaaacaagta gatttaagga aggggtaaat ttcaagctta
124501 ttagggtata tactgaagat ggagaagata atccaattca taagtatagg tttgaagcag
124561 taccaaccaa aaagtaataa ggaggtgact taaatgacaa cattaattgt cgtcatcttt
124621 attgctatca tttattactt atggaacagt gattgagtca agttaattct tgactctctt
124681 tttgttttat ggtatattaa tatatagaaa ggagagatta actatggaaa tggcagattt
124741 agaaagattt gatgcatttg taagactaat ttcagatgat gagctttcgg aggaaagaat
124801 actggagtta agcgtagact tactaaaccc gatactagaa ggaggtacag cttacaaggc
124861 taaaaaacgt attaagagta aatttggtaa gttagaagca aaaaatttta aacgaaacta
124921 taaattctta cttaagtcga tagctcaaat agaccaaagg agataggaca atgacagaaa
124981 gggaaaaatt aattaaagat attgaagagg ctaatagaga catacagtta cagttaaaag
125041 aagtagataa ttataaggac agcatacgtt ctaaaggaac aagaaattat atttctacaa
125101 aggtattaga ttctattatg gttggtttca tagttagttt tttaatactc attataatgc
125161 gtgtacttga atattttgta acaggtaatg ctgtttactc acctttagcg cctgcagtta
125221 ttattatgtt tgttttagca ctaggtacat ggaaagtaag taagatgaac aaaatagtat
125281 cttatagagg aactattaag atgtactggg aactaagtaa tgctgagcaa aaacaagcta
125341 aggtatttaa gtatcctaat gatgaagtag atattgtatc aaaacataac ttaagacaaa
125401 taactttag tgagattaat atacttcatc ttaaatatat gagatataat aaggcagtag
125461 aacaacatac taaattatct aaagaactttt ttaaaaaaga taaagaaact gttgacaaga
125521 acaaataagt gtagtatagt attactaaag gaggagagat attatggtta tacctagtat
125581 taaagcacaa aacaaattca agaatgagtt agagtattat aaacaaggtc acattagtga
125641 aagtaaaatg ttagaattag ctttgatta catccaagaa ttagaacaaa ataacgaata
125701 cgttactaac ttgctagaag aggagagata tggtgagtaa attatcgga gtgtacttat
125761 ttaatttact aatagctatt attttaactt taaccttaat aggtactatt actgactcaa
125821 ttgagagtac tttagcccaa ataatcgtag ggatgttcat aatcattact atatatgaa
125881 tcctatcagc gttaatacct attctagttc ataaagctgt atcaccggga tggagctata
125941 ctgaatggaa tgaatcctat tacatcagat tacctggaga agagaactac aagtactata
126001 gtaaatggta tttagattta ttaggagtta aagaatttta ctataagaga gacaatggag
126061 aagaagtaaa agaaaaaaat atatcatggg cttttcaagc tgaagtaaaa agacctgaag
126121 atgttaaacca ctggaaaaac caattgctta ctaatagacc tttaacaatt ttagaatata
126181 aaaaattaaa gaattagat aaggaaagtg aaattaggaa acaagaagat ttagaagaat
126241 ataaacaata caatagtaat taaagaggtg gaaagcaatg ataagctcat ttgatagtat
126301 actactgtc atatacatta ttatagcttt tgcagtagct atggcaatta tctacttagt
126361 atttaaaggt atgactattc tactagataa gctaatgatg ttattattaa gtaaaactac
126421 attagatgta gaagcttgct ctatgataat ggcagtcatc agtacaattg tgtttggaat
126481 tattgtactt ttaatatggc tagcagtaaa taatattta ctataaggag atttactatg
126541 gattttaatg acttttataaa cagtgaatcg gataggggtag gtaagcctaa acaaaagaag
126601 aaggtagaga ataagctacc ttcttctact cctattgaag ataaggaaaa gaaattaaaa
126661 gagataagaa agaaatcatt atatattgat ttaaggagaa aaagaaatga ctaaagaaac
126721 aaatgtactt tacaaagata agtatagaga ttatactata gttgtaagat tagcagggaa
126781 tattattgtt actgaagtag ataagaaaca taaaacagca tttacaccta ttatattga
126841 caatggtgta gaaggcgtag agcttgtaat gcgtataggt tctgtagagc ttaacatgac
126901 agatttacgt gagttcacaa aagaagtatc tacggctcag aaagctttag aatattttaa
126961 taaaaaactt tacattaaag gcttgacaga tgaagcattt taatatatac taaaagtata
127021 aataaaataa agaaaagagg aatgattatt atgttattag gaattttatg gtttatatgg
127081 ggatttgtat catactttgt attgatgttt ggaattgagt tttggaaaga tagatggatg
127141 ccaggtgtta tcggagcagg agccttacta ctattcttat tttggattat gaaatctatc
127201 cataatgcta tgcacagtagt atacttgtat taggaggttg tatagatgga tatactaatt
127261 attcattata aagaaacaaa taacggggtt ttaaaagaaa caatacaaac aatacaaaat
127321 catttaaatg atgaacatgg tttggttaag atgacagcaa caaaacttag cagagagaat
127381 atagagaaaa gatttaataa ctataatata gtcattgcag aagatgaccc tgataattct
```

```
127441 tatcattacg gtgaagctgt agaagacgca gattttatta tagacatacc aatttcatat
127501 ttagatatac atgcaggaat agaatgggat gttgataatc ctgtagatat gctagatagg
127561 aatcctgatt ttatagaagc tgtaaataaa ctaaatgaag acttaatgtt ataaggagga
127621 aatagaatgc taaatgaaaa actaaaaaac ctggaagata caaaagtata catgattaat
127681 agtattgcaa gtttactaag cgcaagtaca ggaaaatcaa gtaaagtatt ttttgatgaa
127741 gggactatta aaattgtaag tggtgaaaca aaagcagtag aagtcattga taacttagtt
127801 caccctcact caggacgttt acctattaaa acaacagaac gtattgcgct aggtagatta
127861 acagattctt tacagtttgt tatttcagaa atagaagtag ttaaagacca aattatagat
127921 gaagaaaatg aagcttacat tgattttgtg atggaagact ggaactggga ttaatgccta
127981 tggacttatt aactattgct tctgttgctt ttatagctgt agtcattatt gatttgatta
128041 atgatgatat gagctatatg cttactggta ctgcaatctt aataaatatt tgggcaggat
128101 tttatggatg gttttttctta ctgcaagcag gaatgttact tttcttacta ttagctagga
128161 aagttaaaga tgataaggag tcaatactat attccagtgc ttcattaata tgtgcactag
128221 gaatgataat aaatcttctt tcattttctt aaaaataagt attgacacct ttgtactttt
128281 gtattatact tagtatataa caagtacagg agatgattac tatgagtaaa gaaacaatta
128341 gaagacaatt ttcaaatgca attgagatta tggcaacaac taaagaatgg tggaacttcc
128401 ctaaaagttt tgatacgaat aaagaattta aaattaaaac ttttaaaaat gatacacttg
128461 tatttgaagt cagagaaggc agtagaaatt taggaagctt tgtagttttt acaaacattg
128521 attttgatta tgataaacta gaaggaactt caacacaata tatgattaat tactttgcta
128581 agaaattaac taaagatatg tttaactatc ataaattaca attatagtag gaggtggaaa
128641 gatgagagaa gagttaaaac cttttaatag gaaacaagtt aatgttaagg gttacttaga
128701 tgatgttaag tattcaaagc gtagaagaca taaaggtaat caacatgggt gtgttaaaat
128761 cacagttact gatgtaaaga ttaatggtat acctattgac cacgttaaca ttgaagttag
128821 tatctctttc tatgaaaaac taaaggagct tcaaggaaag agaattcaat ttgtaggtac
128881 tgtttataag tatgttaaac atgctagggg gcgcaaaggt agaattaaag gattttataa
128941 agaggattat agcgtaactt tagataagaa gttacaaaag gaggaaaaat aatgattaaa
129001 agaagaaaac atttagacca ctcattacag cctgagaaag gatggagaac agtacctttt
129061 aatgggtatt atgaagcgca tcctacgggt ttaattagaa ataagtaac gaaaaagtta
129121 attaaaggta cacagacaag aaagaaccat cctaagtgga ctgctcatga gattgtatac
129181 ctaattaacc ctaagaaaac aagttattct aggggagtag ttattgcaca tacattccct
129241 gaaatgatta gtcaatcacg aggagacctt aagaacggtc atgtgtgttt taaagatggt
129301 gaccgaagta attgtcatgt agacaatatg tttattggta aaggtaaatgt taacaaaaat
129361 atctataaat taaatgattc ttattttaact agaaaagata ttgaagagga tgttaataat
129421 ttagttaatg aaagattatt ctctcaatta gaattattga ttaagaaaaa tgaaccggaa
129481 agaattacac ctagtaatca ctttattaaa agagataata atgtgttcag tatcacagat
129541 ttatctaaaa actcactagt agagtttgag ttagaaatca agaatattaa gtaaggtggt
129601 tatataaatg aatgagtggt atgctttatg ttattataac aaaataggta aaagaaaat
129661 acctagacaa attaaagctc acagggatgt atctgtatta gaggatttaa aagatagatt
129721 agaagaacaa aatcctaaag aagaatacaa gattaaaaca acaaaagaat ttgataagga
129781 aagtaattaa atgttaacac ctcaacaaaa ggattcatta aaagagcaac aaaaaaaatt
129841 aagtaaaaag aagaaaataag tcttgacaat tgagtataca taggttatac ttaagttaac
129901 aaataaagag gaggtatgac ctatgttatt cgtaattttt atattggcag tactgttttgt
129961 acttggattt atgaatggat ggaactcaga agactagata aggagtggtt gtaatgaagt
130021 tagaagataa agtgttagag agaattgatt ctcttggaaa taaagcaggt aacttaagta
130081 atcaagtaat ggagtcatta gtaaagtatc aaattacgta cggtattata gatattgttg
130141 taagtatttt agttattgca ctaacaatat ttttaggtaa ggtttacctt aaagaatata
130201 agaaggttaa aatggattta aaagaaagct tattgtatga tgattacgat gacttaagtg
130261 gtatcggatg gtgttacaca attctattaa tactattaac gttattctct ctttacgcaa
130321 tagttgcagg tatcccaact gatattatga gattaattaa tccggaagtt tatgcagtaa
130381 aagatttaat tgagcaagtt aaaggaggaa attaaaatga aacaagaga ctttgaattt
130441 gaagaggatt ttgtattaac ttatgagtgt gaggattgta agcatttcga agactggggt
130501 catgatgaag agcctgaaga atgtagtgaa tgtggaagta gtgatttaat caataataca
130561 agtcatgaag atactgagtg tgatatgtgt cgagggtata ttgatatgtg gcaagatgga
130621 tatagatata tgggagataa taaagagtat attgaaaaag aggaatcagg tttgatttgt
130681 gaagattgtt atgagaaatt agatatttaa taaggaggaa attaatatga ataaagcagt
130741 agaacaagca agtaatgcat taggtcaagg attttcagct atggtatggc atcaagtatt
```

```
130801 agtagggtta gggtttattt tattaggatt ggtattatct ttactggttt gggtattagt
130861 aaaaaaattc catgtacctt ttaatcaccc gacagctttt gtagtgtact caattatgtt
130921 agtgagtatt gttgctagtt ttatttgggg cggtttacat gtaattaacc ctgagtatta
130981 tgctatttta gaacttaaag gttttataaa gtaggaggaa ttctatgact aaagaagagt
131041 tagagcaaaa agtaaaagaa cttgaagcag agaataaaga gcttaaaaaa caaatagaac
131101 gttttgaaga cgaaggagga aaaacaaaag atgaacagta gagaaaagaa aattttaaca
131161 ctaacagtaa ataattttt aatgttagct ttagatattg tagcacttgt taggtacaag
131221 aaaggtaaaa ttaagcaaga gaattataac acaggtcaaa tttcaagaac tatagttaca
131281 acagccaact cattaggtat tctttaccta gaagagcaag aacgtaaaga aaaaaaatct
131341 gttaaaatag gtactcttga aagtggtact ctaagagggt ttaaaaataa ataaaaaagt
131401 ttaagaaacc tattgacatt aggtttcttt tattatatac taagagtata agaaataagg
131461 aggttaattt atgaatggta ttattgtatt ttacaaagaa gaaaataaac atattctaaa
131521 gaagctctta gaattcatta acacaacatc aaaaggatta acttacacct tagagggtac
131581 attagttgat aatgatatcg ttttacttaa agataacaac atatgtgatt ataacctaag
131641 acagtttagt aagacaaatg atggcttagt tataggtcta ttgagtgaat catataatga
131701 tgttcattac tatgaaaaag gagatgccta cggtatagaa agattaacta tgtatttaga
131761 ggagatgagt caataatggt aattgcattt tttattttag gtctattatt agtattatgt
131821 ttagttggtc ttgctattat taaagtacta gaagcaaggc taagaaaaaa agaactaagg
131881 agagaaagag aatcttttgg tattcctgaa ccagggagaa aattagggca cataggatat
131941 gtcgaaagta aatatgcttt aattcataaa gaatcaagta agataataat aagcgcagag
132001 aaaagtaaag ttgtagaaac attacagaaa atgtataatt tagagttaac atctgtagat
132061 gtttctagtg taacgggact ctctccctta ggtacaggac gtatggagaa tatggtattg
132121 ctttcataca aactagaaag agaatgactt tataaattaa ttgaacttaa taaggagtga
132181 tacaatggaa tttatagata aaaataatgt aattaaagct tatgatatac cgaatgttta
132241 cttaaaaggt tacgtattgt atgcatgtga taaaaatgga gacattacaa cctatgatgg
132301 gtatgaccaa atacactata aagatggtag agtattaaca ttccctttg ataagccgtt
132361 aagaaagata aatgtacttt caggatatta caaactattt aagaaggagg acatactatg
132421 atttattttg ttagtgattt acatttggtt catgataata ttagagaatt tgaagcacct
132481 acaagaagtc attggaattc agtagaagaa atgactgaag gtttgattga actatggaat
132541 aacacaatta caaataatga tattgtttat aatatcggag actttcttctt taatatgaaa
132601 ccatctaaag tagaagaaat acttaataga ctaaattaca aagagatgac attgattgca
132661 ggtaatcatg accataaaaa gcttgttaag ctatatgaac gtaatggtat cacagtgaag
132721 tatgctgata tgcttaagaa ggaaggtaaa agattttatc tgagtcacta ccctacactt
132781 attggaagaa agaatatgtt taatattcat ggtcatatac attcacaact aatggatact
132841 gattaccaca ttaatgtagg ttatgatgta gaaggaaaga ttgcatatag ttttgatgat
132901 attctaagta tagcaggtga gtatagtgga gaaattcaaa ggtaaagact tatataagac
132961 tagaattaga aaacaaacaa ttaaaaattt aattattaaa gtagagaaat tacataataa
133021 acatagccct tatcaaccta ttggtcatgt ttattattac cctaaaacaa aagagtttac
133081 tttatctaaa cccgagcaaa agatatttat agtgtatatg aaagaattag gtttttaatgt
133141 aaaacacaag agacgtaaga aaacacttat tatttataag aatgcattca ctgaatacat
133201 tagtaggtat catgaagcaa tagagcagat tgaaggaggg aaataatgga atatttattt
133261 ttattttatag gtattggcat gataatttgg ggtttcatag cacccttatct tgcatttgta
133321 gtttactata aacatgtaag agaaaatcat aatggattca gtgatgagga atctctagaa
133381 gaggctatag tatttggtat gggattcatg tttatagcat ttattcctat aggtatacta
133441 gttgtaattg aagaaattaa gatttattc ttttaaatgt tgacagctac aatatagtgt
133501 gttacagtat agaaaaggag gttaattaat gaagcatttt attttaattt taggaattgt
133561 aatactagtt attgcattag gtattgtttt accggcatgg atttacagt tagtactatc
133621 tgcattcgga gttaaagtaa gtatttgggt atgtatcgga atatttattt taatcagtgc
133681 aataggaagt atgtttagca gaaattaaag gaggaactat aaatggcaaa atatgaatca
133741 aatattaatg gagagaatta tattgcaaca ccgtcacaag cttaagaga ggcactagca
133801 aaattaataa ctgaagaaaa gagctttgcg gagtaccaaa ctaaaggtga ggagcagtat
133861 gaatcacagt tacaactaag acactttgat acaatgatat ctcagtatga ggaagctatt
133921 agagtactag aagataaata tagacctcag attttttattc cgaaagataa taaggaggaa
133981 aattaattat gaaagcagaa tcaatagcaa gattttttaa tgacaaagta ctacaaatag
134041 agggttataa agtaagattc ttacaggcta gttcatcgta tattttagat atagatacta
134101 tagatgaatc agtattgttt ttagaagctc aagtatctac actttcaggt aaacatttat
```

Figure 15 (contd.)

```
134161 tagatacagc tattacaatt gagagacctg aaacattaag tgctaaagag ctatatacag
134221 aaattagtaa taaactacaa gctattgtag gagaccaaac taaacaaact atagaactat
134281 caagatattt taaggaggaa aaataagtgt ctaataaaac cattacaaat tatttattaa
134341 atttagaagg aataaaagga gaaacgtata gtattattgc tcatatcaat aaacaaactg
134401 gttggggtga taaagggat tattttgaaa taagcataag ttataaagct gataaagacc
134461 ctagaacaac gagatatatt acaactgaaa ttttgttga ttatggtagt aataatccaa
134521 aagaaatttt attacaatta agagataaga tttttctat tgtagaagaa caggtagaga
134581 ctgacaatga ttttattgaa tctattaaag aaattaattc aactaaagaa ttagaaaaac
134641 taaagcctta tatcaataat gaatattatt caatgtttaa atcttctatt gaaaaggaaa
134701 tacctgtagc tttatcttct gaagtactca atagatgtac aggtaaaaca agcacattag
134761 cttatttagc actagaaaag gatttacccct tagtagtatc aaatgaacct atgagaaaaa
134821 tgcttaaaaa taaattccct catcttagag tagcttctgc tgaagattat tcaaattatg
134881 atattaaagg tgaaattgtt ctaatagatg aagtagatat tgaccagtta tatagtgctg
134941 ataaagtatc tgttgatgca cttttagtgg gtatcattaa aaattaaata aatttataaa
135001 tacctgttga cagcctgttg acagcaggta tttttatag tatactttag atataaagaa
135061 aaaggaggta atataatgat acccgtaata gttatactta ttggactcat attattttta
135121 tctagcggtt ataagttggt attgggtaag tattatgatg atgtagattt aaaatacta
135181 tttaccatat ttggtgttgg gattgcatta ctacttggag gatttatatt ataaagcagg
135241 agctatttta ttttaaggag aggtaaatat gaattataga gatttatta cagattgtat
135301 tagcggtggt tacaacgtac acatcagtgt tacagaaaaa cgagtacaca ttatttctga
135361 gatgacatca gcatcttacc ctaaaaagga aattaactta gatgaactac aagcttatgt
135421 gtactatatg aataattttg gaagtcaaat tacaacggag gggtataaa tggaattggt
135481 tattaatatt gtagcagtat tggttggtat gtatgctatt tattcatg ttcaaagtt
135541 tagtactggc ttatcaggta ttaattgt tttaggggatg gctattggtc ttacttcta
135601 cttagactat ttaaatgtca gagaaaatgt tattcgatta gtttcagtaa tgttcggagc
135661 tttcttattt agtattgaaa tgatttataa taaaattatg ttcgaaatta aaaaaagcaa
135721 tgttcagaag actgtagag tgtatgataa agagcagtaa tgattttacc ataagagtac
135781 ctaaattact ttaagtgctc tctatggtac cttaaagtag cttagaattg aaattaagga
135841 gatgaacaat tatgtatcct gaaatagatg tggaagaatt agcgtataag ctaaaaagta
135901 caagagagta tttagagagc attacaacaa aagaagtaga aatttatgaa atctatcatc
135961 ttaaaacagg taagttagtt tttaaaggtg aatacattga ggtaaaagaa ttactgagga
136021 aaatgtataa agaaaattta acacttgtag atgtagatac aatgttaagc attggtaaag
136081 gatttattga tgtaattaag aatatatcgg cagaaaatgt attccaaata acatataaaa
136141 aggagctatc aacaaaatga ttaaaatatt ttcagaagta gataaagaat acaaacctat
136201 tattactgaa aagtttccta atggtgagat taattttaaa tatgatgatt taaagtattt
136261 agtagaagag gacttaagat ttgatgtttt ctttaaatgg gaaaatgacg cagacttaat
136321 gcatttgtat atgtttacta agtatttaga gcaactaggt attaaagata aagctgaatt
136381 tttagagatt gcatatctac cttatagcag aatggataga gtagaagaag gacataataa
136441 tatgttcagt cttaaataca ttacagaatt tattaataac cttaattata aatcggtatg
136501 ggtagcagaa cctcatagcc ctgtaacaga agaattactt actaattctt ttgctattga
136561 tgttacactt aaattattaa atcagtatat tgaaatgtcc gaagagcctg taacaatagt
136621 actacctgat aaaggggcat acgatagata tctatttgat gtagaacgta tcttaatgga
136681 atctaatatt gaatcatatt caattgtata tggtgagaag aaacgagatt ttgaaacagg
136741 taagattaaa ggtattaaaa taattaaaga taaaaatact ttatatgata attgtattat
136801 actagatgac ttaacaagtt acggtgggac atttgtcggt tgtaaaaaag cccttgacaa
136861 acttaaggta agtagtgtat cattaatatt gactcatgca gaacgagctt ttgcagaagg
136921 agcattactt agctcaggat ttaaagatat tattgtaaca gactctatgt tccctaaaaa
136981 taattgggaa aaagctattg ctaaacatag agctagaatc aacggaactg aattacaaat
137041 aaaagatatc gaaagatatt tataaaagga gaaaaataaa ttatgctaaa tccaactta
137101 atgtgtgact tctataaact aagtcacaga gaacaatacc ctgaaggtac agaaattgta
137161 tatagtacac tagtacctag aagtaataaa tattatgaac acagtgataa tattgtagta
137221 tttggttattc aatcacttgt taaaaatat tttattgata tgtttaataa agagttcttt
137281 aacagaccta aagaggaagt tattaatgaa tacaaacgta cagttaaatt tacactagga
137341 caagaaaatc ctgatgctaa acacttagaa caattacatg acttaggtta ttacctatt
137401 gatgtaagag cttttaaaga aggtactgtt gttcatccta acacacctgt tatgacaatt
137461 gaaaatactc actcagattt cttttggtta actaattacc tagaaactat tattagtact
```

```
137521 caaacatggc aagcaatgac tagtgctaca ctagcatatg atatgcgtaa aatgctagat
137581 aaatatgcaa tggaaacagt aggtaatatt gaagcagtag atttccaggg tcatgacttt
137641 agtatgcgtg gtatgagttc tttagaaaca gctcaattaa gttcagcagg tcatgcaatt
137701 agttttaaag gtagtgatac agtacctgta gtggatttct tagaatcata ttacaatgca
137761 gacgtagaga aggaaatggt tgttgcttct atccctgcta ctgagcactc agtaatgtgt
137821 gcaaatggta attatgaaac catggatgag tatgaaacat ataaacgtat gttaacagaa
137881 atatatccaa caggcatttt ctctattgtg tctgatactt gggacttttg gggtaatatg
137941 actaaaactt tacctagatt aaaggatatt attatggaac gtaatggtaa agtagtaatc
138001 agacctgata gtggagaccc tgttaaaatt atttgcggag accctgatgc agacactgaa
138061 tatgaacgta aaggtgcagt agaagtgctt tgggatacat ttggaggtac tgaaactgaa
138121 aaagggtaca aagtattaga tgaacatgta ggattaattt atggagactc tattaactat
138181 gaacgtgctc aacaaatttg tgaaggatta aagaaaaag gttttgcaag tattaatgtt
138241 gtattaggtg taggtagttt ctcttaccaa tttaatactc gtgatacca cgggtttgca
138301 atcaaagcaa cgtatgctaa gattaaaaat gaagaaaaac ttatctataa aaatcctaaa
138361 acagatagtg gtaaacgttc acataaaggt cgagtagctg tatataaga cggttcatgg
138421 gaagataact taaccttaca tcaatggcta aacaaacaaa atgttaatca attagaaaga
138481 gtatttgaag atggtaaact ttatagagac cagtcgttaa gtgaaattag agaaataatt
138541 aaaaataatt aataatatt taaactccct attgacaaag ggagttttt attatatagt
138601 agggctatag taaataaagg agtgaaagaa atgatttata aaatatcaaa acataattac
138661 tatagtaggt ttgaatattc atcttattta cctgatgaag gatttgcata tatagattat
138721 gtagatgtca ttcttatagg tgtagataat ccaaagaaga gaaaagttat tactttaaaa
138781 gcagatgagt ttaatcctag tgatttaag gttggtcata aatataatat tataaaaata
138841 ctatggttg agaaatggga atggttacag ccatagggag gagaggtata caatgattat
138901 agataaatta aatggagtta aattagagat tggcggtcat gttgtatcat ttagtgtaag
138961 taagtttaaa acgattaatg gtgaaagaca attacttgat taccaccata tcaaaagagg
139021 taaacagaga tattttagaa ctactgagga attctataat gagtcacaag aaataaaacc
139081 ggataagaat gagatagatg aaatgttga atctttaggt tacgtaaata ctgaattaga
139141 agatgtagta agaaaccaag agaaagtgac agagatatta ggagttagtg aacagtattt
139201 aaaccaattg tcttataagg ctatagagga atatgtagaa aaaatagtta tcttagaaat
139261 taaagaatta aaaggagaga tacaatgata aacattaatg taactgaaaa agaaaaatta
139321 gttgtaggtg attagtaaa atcaagagaa gatggtacat ggggtattgt agtagaagat
139381 aagcaagact taaatgtagt tgtgttaaat gacgagccct ggttatttta taaatcagga
139441 attaaaagag tagaagggca attagaagag gactttaaat ttattaaaaa cagagaagag
139501 tatgatatag atgtagttaa ttcttcttat aaataaaattc acatctacct attgacttag
139561 gtagatactt attatataat agtatacaag gagatgaagt atgatgaatg gaaaacaaat
139621 ttatgtattt ttaagtgacc aatacagtaa agatatactc agttacaat taggtcttat
139681 taaggaatgg tctaggagag aactaactta ttcagatgat gtcggttcag atgcagatgt
139741 tgttatttgt actgatatag taagagatga tttcgtaaaa aaactaagta aaaataatag
139801 caatgcatta tttgtattta ttagttctag ttattggata ggtataaag gcggagaatt
139861 ctttgttgca gttcaagact atgtgaaagg tatgtaagat atgaaaaat tattaatatt
139921 atttacatta gctagcactt tactattagc aggatgtaca ccggataatc atgaaggaaa
139981 agttttagga acaggagaat atagagagcc aactacttat atcaagtcag gaagtgttac
140041 tgtaccagtt attggtgaaa tgaaatacta tgtagactta gaaacagata aaggtgaaga
140101 ccgtgtttat cttaataggg aagtttatcg taaatttgat aaaggtgatg atttctctaa
140161 tgtaggtaaa aaagtatata aaaatgatga attaatatat aaagggggact aattagtatg
140221 aaacaattta tacatgataa aaaagatagt tataatagta caaatcgtaa ttttgatatt
140281 caatattata aaggtatacc tttacaacaa attgataggg ggtatggtca agcaagagct
140341 aggagattta caataaaata tacgaaccaa aatatatgga tacctatgac atatttaaaa
140401 cctaatggta ctcttaaaaa taacattgat atagattgga tacttgttaa agaaaaatgt
140461 agtttaaaga aagcaggatt agtaataaaa atagaaatta caggagatgt attataatgt
140521 atatattaga aagaacaatt agaggttttg caggtcaaac agaagatatt ttaccttaaa
140581 ggagatgaat taataatgga gtatgaaaaa atgattagag aaataatggt aaactctaaa
140641 gaaatgtcac tagaagataa aaaacattta atgagtttat tgatgagtgc ttatggtgac
140701 ttatcaatac tagtagcctt tgaagaagaa aacacagcac atatgtatga agaaataaaa
140761 cagtatgata ctaaaaagtt actgaaacca agtatggtaa gtaaagataa ttatatgaaa
140821 taatatgtaa ccaatcagga ggaataacta atgataaata tagaacatga ttatacaata
```

Figure 15 (contd.)

```
140881 agaactgtag ataatagaaa gtatacttac tatagtaaac atgaatcccc agttacttta
140941 tataaaaata ttataagtaa agattgtatt gaagtaacta aatatgggaa agataaaaaa
141001 gttattatag ctactaaata tattgtatct attgaacgat ggtaattaca aggaggagta
141061 gttatgaatg ctagggaagc acgtaaaaac actaaaaact ataaggactc taatgtagta
141121 actaaagagc aacacttaac ttatatctat aataagataa actacttgat tgcaaatagt
141181 agtagtcagg gtaagacata tgtggcaatg aatctaagaa cagattatcc tgatgagttt
141241 tctttatcta aattaaaata tctaaaagaa attaaacagc actataaaga cctaggattt
141301 aatgtgaaaa cgcaagtaag aaaggcaaag tggtcagaga aaagtgtaat caggtactac
141361 tttaacttag gctatataga cagcgtgtta gtacctatta tacacattag ttggtaatta
141421 caaggaggaa tagttatgtt ttttaaaaag aagaagttaa gcaatgtaga gaaacaaata
141481 agacaaaacc gtaataaaga agacaaagaa agaaaagaac atcaagataa gttaaataca
141541 gatatgtata aaacgtatga attagataaa attgtagaag aacatttaag aaaattagac
141601 aatatatccc ttgaaggatt agaactaact tcagtgtgtt tagggacaag acttgtttat
141661 tattattcaa taggcaagga ttgggataaa caagtatata gtttaaacga attagaatat
141721 atgaagaaga aatttaagaa actaggattt gaaactcaga taacaaacga agatatagga
141781 tttcaacctt atatttattt aagattatta tgggatgcat aagtaattat tattagagga
141841 ggaatagttg gtgttgcaca gttaattacg gattatcatg acggacatta agtattgaat
141901 attgttgact aataataaga agaaaatatt attactacta agtaccttg ttatgtacta
141961 ctattactac tactaagtac cttgttatg tactactatt actactacta agtaccttg
142021 ttatgtacta ctattactac tactaagtac cttgttatg tacttgtact actattacta
142081 ctactaagta cctttg
```

Recombinant NanoLuc® 812 phage (142631 bp) (SEQ ID NO: 15)

```
   1 ttatgtacta ctattactac tactaagtac ctttgttatg tactactatt actactacta
  61 agtaccttg ttatgtacta ctattactac tactaagtac ctttgttatg tactactatt
 121 actactacta agtaccttg ttatgtacta ctattactac tactaagtac ctgggaattc
 181 ttttacctct ctcactcagc ctattactta ttaccgactt ccctaactac ttattctata
 241 gttataatat tcatttatta tacaatactt aaactatagt attctactgt taatctatgc
 301 tgaagcggtc ttaatctatg gttattatat aataatctta tataatggta cattaatcta
 361 gtatattaca ttagaatcat tctaatctag gattttaatc tttagaccct aggaaaagtg
 421 gtactaaaat ataaaaccct ataggtatgg gattcttatt tttaaaatta ctaaaaagta
 481 ttaggttttc cctagggcaa agttttaatg tacttaaaat agtaagtagc tacttatcat
 541 ttagggttct ataattgaga atattgagag ataatccgct tcaattgtaa ttaattgttg
 601 acaactatga agcgggtatg ctataattag gtatagtcaa atttaggaga tgaaatagat
 661 gattgatata tacttaggag aaggttataa taaagaatac ttgtctaaag cactcagatt
 721 aatcaatgac catgctccta gggagttaag ttatgatttt aataatgtag aagcggatgt
 781 taatattcac acaatgttat atgttaaacc tgaagataga tttatatata aggatatatc
 841 ctatgacttc ccgggtgatt taattatttg tatagttgat gatgatgcta ttgtatacca
 901 ccaaggtgag cagatttcag gtattagtat tttaagaata ctagaagaga tattttaagg
 961 aggataagta atcatgatag gaataacaat attaattacg ataatgagta tatcaactat
1021 ctctatgtat atttattttt tagtagactt gattcagtca atcagatata atagttttga
1081 taaggtaatt aacgtcataa catttgtact tatgacagtt ataatagcat caggtatttt
1141 agctatactt ggaatataga gctcatttaa gaagcggtta agtagtttaga ggggatttgt
1201 cctaaaatag tataccgctt ctatatggaa ggctgagagg tcttagaatt gaaaggagag
1261 atataatgat tcatataattt ttaactgata gttatgataa taaagtttta aatactgtac
1321 tcagatatat taatactact agtgatagag agcttagtta cttaatgggt aaaggtgaag
1381 cggatgtatg tatagaaaag ggagtattta gtaatataga agatgttaaa attgactctg
1441 agtttattga tagaggtaac ttatgtatac ttataaatga agatggatta gtatgtagtt
1501 actacagagg agaatcatgt aatgttggtt cctttgtaaa ggagaggtta taatgataga
1561 aattaggtta actgaagatt ataatgactt gagtcttaag gcattactaa aacgtattaa
1621 aagggtagct cctagggaat taacttatgg tttagaagcg gatatggata ctacagatgt
1681 taatattgga gattcagttc cttctagagg tttatatgta gagtactcag aacgttttac
1741 tagggactta tggataattg tacacccttc aggttatgat gcttattatc aaggagagaa
1801 atatggtgga gagtctttag atgagattat acatgatatg tttatgatt atgcagaccc
1861 ttttgactta gattattaga aaggagagat tataatgata gagatatacc ttagtgaaaa
1921 ttatgataag aatttactaa aagcagaatt aaaatggatt aaagagaccg cttcaagaga
1981 actaacttat gatattaata ggaaacctgg attggatgtt tatgttaatc cctataggtg
2041 tactaaagac gaagttgaag aatggagtac acttcctcca tttgaagatg atatacttgt
2101 atttatagcg gagacgtgga tacatgaata tcttaagggt gaatcaatag gtgtagatag
2161 tatggaagag tatgtaaagg agatgtaact aatgtttaag gtatattata cagtctacca
2221 tagaggtagt atgaaaacta ttaaggataa gctagataga agtagtttaa tatacttctt
2281 gtatgatact tggtataaag atattagtaa cgtattccct aatcactata ataaagagtt
2341 tgggagtaag agtgatgata tagatataga taaacttatt gaagcggtta atgaggaagg
2401 tatattactt atcaatagag gtaattatgt tacaataaga gaatggtagg ataggataaa
2461 cttaggatag aaaataattt aggatgagtt acaataggat aggataggat agggggttaa
2521 gttaggatgg atactttaac atacactatt attcataaag aatctgatag ggtaatagct
2581 agcggtttaa atgagacaga aactatgaac ttagttcaaa ggatgataaa tactaatcta
2641 gttactgata tatcattaga tgattatata cgcagaccac atggaaagat agatgtagtc
2701 aatttactag tagatattag aagacaaggc gtatttgatt tcaatcacat ttggcacgta
2761 ggataggagg gataggatga tagttatata tacagatgtt tctaaggatt atttaaaaga
2821 cgagttctta ccttggctta atgaaaggga tagatactta gaatactata aagatgaatt
2881 acctgaggat atagattcct cttatattgt atcagttgta tactgtaagg atatggaagg
2941 tctattagaa agaaaagaca ttgttcttga taatagttat aatgaacctg tagctttatt
3001 aggtgttcct gagttttttg gtaattatag taattatttc tattatagag gagaaagtat
3061 tagtaaacat gacctaggag aaattgttag gttaaaagct tggcaacgta tgggtgggga
```

```
3121 ttgactaagt agctctccct aatttcacta agtagctccc taggaattgc ctaagtagct
3181 cggtatgatt ttaccctaag tagctccctc tgttttctac tagtttattt taaccgcttc
3241 aggtgtctat atatatatag acggttggaa taatatcaga ccgcaaaaat aaatacacta
3301 ggatattatt cccagtgtat tatataattt ttttatagaa tatttataac attgtattca
3361 aattcattta cttcatgttg tgatttaatt aaattttaa ttaatccgtt ttgtgttta
3421 tactcttta ttagttttc atttctata attaaattat taaattcttc ttttgttgtt
3481 tcctcatcta cataaaattt actttcatat atttcataat attttttatc tgttccgcca
3541 tctaaatcat ctgatatttg ataattttg aatataattt ctttgtttc taattcattt
3601 actaataatt gtgatttgc atattgtaat acatcttcat tgtcccacat tggaatatag
3661 tttattttca tttaaatcaa atccttttct tataattttt ttatataata tttgtagaag
3721 cggttggggt ttgtcccttg ccttactaca ctttatatat tacagtatag ttattcagaa
3781 gtcaatactt ttgagtaact tttttaaat tctttttct tctatataat agtagttttt
3841 agccctaaaa atgtttttaa aagaatttgc attttcttat tgactttatt atcatatggt
3901 agtaatataa aggtacagca agggaacagc aacaagatat tagaattata taaaaaaatt
3961 atttaatttg agatgattta aatggatgta aaagaaattg caaatactat aatggagttg
4021 tggcaaatgg acggctacag atgtgcagaa cctccattat atgaaagcac actaaaccac
4081 acacgcacac acacggcgtt aattgtttct attaatggaa actatgacac agtgcagatg
4141 ttccgcaaaa cgcctataat gagcatgaga gggcaaagcc aaccggctag catgttagtt
4201 aatgtgattg acgatgtaat tataatcgta tatgaaaatg tagtgtacgg agttcaaaac
4261 aaagaaataa aatttattga agaaatttaa aaataggggt tgcaatcctc aagcatctat
4321 agtaatataa taggtgtagg ggatagcaac acacctcaaa aaactttta aaaaagttaa
4381 agaaaagtgt tgacaccta caagatacat gttattatta agataacaaa taagacaagc
4441 cacctagcaa ataacgaaat taaataaaaa aattatagaa taggatttga ttattatgac
4501 aaacaaaaat tacttatacg aagaaactca cacagtacaa gggcaagaca ttacggcttt
4561 cagaattcca aatgacgcaa acggcaaccc acgttatgta gtgaattca gggacttagg
4621 tatcggatta tgggactatg acaacatcaa taaactttac ggatttaata aatatcgtgc
4681 caaatggttt ggcggtggtg tagtattcca aagctataat atagaagata cattaaattt
4741 tgcactagat aatgttaaag aaatagaagc ggttaagaat taaaaccgct tctgaattaa
4801 ataaaaaatt tatataaaaa ggatatgata atatgaaatt taaaatagaa aaaaataata
4861 gtgatataaa aactttatgg aatttagcaa aaaatggata tatgagctat caaactgtac
4921 acaatatatt taaaaatgaa tcagatgaat ttattatatt taacagtaaa caaacttata
4981 ataaatttat gaaattaaga tataatagaa gtgcaataca ataaatataa aaaaattata
5041 caattcccta ggattagatt tctagggatt ttatttatt ttaatttata taaaaaaatt
5101 atttaataaa taagttagtg taaaattgac tattgacaag gttgtatttt ttatggtata
5161 atgaagtgaa gaccttttt agtataaaaa aattattata taaaaaattt atattaaatg
5221 atttagaaa cgctctttcc cggaacctct tctcttatat agcggacacg taggctcctt
5281 accgctttct tactatactt atagtatact atagaaaaaa gaaaaggtca accctttct
5341 ttaatctttt ttatattttt ttataattct tctaacggtt atttcactta tattatattc
5401 ctttgctaac ataggttgag tgtactttct aggcttgtat ttgcttgcta tggcttttct
5461 ttcatcttct gttaatgcat aaccctatt atacctattg aaagtattgt ctttatggtg
5521 cctttattg tgttctgacg ggctaataca ttctaggtta tcaatacaat tatttgtt
5581 gttaccgtct atatggtgta catggtttga tttaataaaa tcattgccaa aatattcata
5641 tacaagtcta tgcaccatgt gttttttatt attgaccctt acggttaaat atccgtcacg
5701 gtcttgatgt acttactca acctatcatt tatttttacc ctacctaaat tagaaacata
5761 aaaattatat ttattaaagt attctttt tataggtttc caaatttcat taatttat
5821 ttcaaccatt ttttactcc tccttttttg gtatcacttc cattatataa taattcggtc
5881 ttaatgtcaa tagataaatg taaaaaagtt ttttaaatta atttcattaa atctattgac
5941 tttaatatca ttatagttta atataaaggt ataccaaatg aaagggattg aacaaaatga
6001 taaaattcaa atggaaaaac aaaacaatta aatcaactca aaaaacggat aacattctat
6061 tacttattat aggtggttta gttgcaacaa tcacacctaa acttgtaaac tggttttac
6121 tactacaaga taatataaat attttttaa gataactatt gacaacctag aaacaacatg
6181 ttaatattaa gataacaaat aaatcaataa aggaaatgat aaaaatgaaa aaaatcacaa
6241 caactttaaa cttaatcggc atgaaaaata atgaaaggtt tacagaagag ttaaaaaact
6301 accgtcaaga tgttactttc ttgaaagcaa ataaaattgt aaaatattca aaataaggct
6361 tgacaactta aacactacat gttattatta aggtacaagg taagggaagc ggtcaaccgc
6421 ttccaaccta aataaaaaag tttaaaaaaa ctattgacag tcacttgaaa ccatgatatt
```

Figure 16 (contd.)

```
6481 attaagataa caaaaaacaa acagaaaagg aattgattat aatgaaattt atcaaaacta
6541 tcgaaaactt attaactaaa gcagaaaaca aagggcaagc aatttaaac ggtcgttatt
6601 atgacggata tagaaacggt gagcttgagg aaaaatatgc aatcgaaatt gatggcaaca
6661 aattaattat gcgtcattgg ggtacacaaa caattgagat tgacttaagc ataaatgaaa
6721 ttgtttcata ctatggtgaa agcaattcag accgtgacag tttaaacaca cttgtatatt
6781 gcttaggaat tgcgccaaac tttagatact taccaagcaa agacttgttc atttacgaaa
6841 attaattaaa taaagggctt gactttcaag ccctaccatg ttattattaa attgtaaggt
6901 aatcaagcac aacgacaaaa taaactgaaa aggaattgat acaaatgaaa ttaatcaata
6961 gagataatga aatcgtaatt agcatagcaa cacttgagag tgtaaaacaa gccctaattt
7021 gggagtacat cgaccactta gataataaca tcctagacaa agaaatacat gaccaggaag
7081 cggttgttat tacttcagac actttgcaat cactcaaatt tgcggacact atggaagaac
7141 tagaagaata tgtaaacgac atcggttgga aattagttta gaaaaggtat tgacatccta
7201 acatatagat ggtaatataa gagtatagaa aaaataaaaa aagaaaagga tttgattatt
7261 atgacaaata caatacaagc attttttacaa ggacaagaag caagcacagt taaggacgta
7321 gcaactcatg gagtacaaag cggagcaatt ggcaaattaa tctacacatc agacgtagta
7381 aacttctttg atagttacga gcaggacatt gaagcggtca tcactgaata cattgaagag
7441 gttacaggac aacaatatta tgacttattg aactatgagc ttatgagaga cctcgagaat
7501 tatgcaaatg tagaatttga agacgaagac gaatataata acattcaatt tgacctagca
7561 gaaaacattg cttctgatga ggttgaagga tttgaagaca tggacgaagc agaccgggcg
7621 gaagcaatct atgaggctat ggatgatgtt gaattagaac tacaagaaac tgacaaggtt
7681 caatatgtta atctagcggt tgagattgta gctcaaagaa tggcactata gaaagcacac
7741 agagaagctt aaccgcttct ctaatacaat taatcaggag atgttgaaga tgaatacaag
7801 acgggtaaac agagcgttaa acgaagcagt tagattatta gatgaacaaa tagcagatac
7861 tcaaaagact atgcaggagt tgaataaaca actagagaag caaataaagg ctaagcaaga
7921 gctaatggta ttagttgatg ttatgaatgg tgatgatgag taatgaacat tagagaggtt
7981 cacaatgtcg ttaagagtgc taagagcaaa ctcctgcagg agcaggctca cccaacggat
8041 aacctcatag agcagtacat caatgatgag ctacacagac gcacacagag aagcggaaca
8101 atacagatga acaataatac tacttcatat agtaatagcc catatggtag cttagaagag
8161 cttagagaag cttatgacct atcgtcatta tctactggtg agattaaaga actaatacaa
8221 acatttgttt aaattatttt atcaaaacgc tttacaatct tttagtttgt atgatataat
8281 gaacttaaca aattaaaaga aaaggaaatg atgaacatga caaacttaca agaaagaaaa
8341 caagaattga aaacgttact atttaactta gctttagaga agaacaaagc aactgatgag
8401 acactgctta gcgtattaga gcaagcacat caagaggtag gaaatcaatt aagaaaagta
8461 agaaaagaaa tagaaatttt agtagaagaa aaagaaaggg aatttggaa tgatatcgaa
8521 tttaatggat tagactaaga gggaataaaa tccctctttt attttatcc tattatataa
8581 tttttttata ttatacgggg gcagggtaa aatgccactc aatgggggtg ggtctatata
8641 cccctatggt ctacccaggt acttatttt tggggaaaat tatgaaaata aatatttaaa
8701 agtcaacacc taaaatatag aacgtaagtc aacaccctat attaaaagtc aacaatttat
8761 agtacaaata gagaacctct aaatataaag tcaacatatc taaaataaga aagagggaaa
8821 ttaaatccct cctcttaggt attattaaca acctctaatt catgtatagt aatcatatcc
8881 atcccataga aatctcttgg gtctccttta atgaactctt gctctcctct atggttttgtt
8941 tcctctttat aaccttcttc tttaatacgt ttaattaagt tctccttatc tgtatatatc
9001 ttatcttctc taaaatggaa gttatcttca taaggttcac aattatcatg ttctacttgg
9061 tatagtttca ttagtcattt tcctcctctt cgtaagacca tgtaccatat tctgcattat
9121 agtgtgctgt atctgcgcct tcatcttcat attctacact ataccatgca tcctcctctg
9181 tttctgcatc tatatatctt acctcttctg tagtaatagt acgttttact ttgtatctct
9241 tcaactgttt ttactccttt atattttcct ctagtatttg tttaatgtc tgacagtctt
9301 tttggtctag agtatcccaa ctctctaaat tttgtaattg gtatagtaac tcatttacaa
9361 tttcatcgaa ggcttctgct tttttatata cttcttctag ttctgtttct gctaattttc
9421 tattcctttt aatttgttct gctttagcta ctaagatatg ggcttattc atttcctcta
9481 taataaagtt tttatagttt tccattatta tttatccctc ctattttcta tccgttgttt
9541 tatctcttct ctattgcggt ggtgctcctt actcatttct ttacgttcct tatttgttaa
9601 cctatcccta taaacaaggt agttaatgta taagataccg gctgaccata gtagcaagaa
9661 tgatattaaa taagtccatg agatactaat ttctatcatt gtgagtcctc cttatattct
9721 ttatagctct taatggctat tttacaaata cctctatttta cagcaacaaa tactataaat
9781 gataatagtg ttataactgc tcttacatcc cctgtaaaag gtaatgattg aaagagcaaa
```

```
 9841 tagttttcta aaacactaat agctgtaata gtagttagat ataatataga taataagtaa
 9901 tcctttaatt ttagtttaac aaatggtttt ttgtgctcac ctgttcttac aataccataa
 9961 agtattatga accacataac agglactaac tgtataataa aatcattgtc tacatttaat
10021 gcatgtagag cgtaaataat aactgcagga atacctataa tgaatgctag aaatacataa
10081 aatataatta acattatagg aagggctaca agaaaaccta gaccttgttt tgaatactct
10141 aatgtgtttt tacctaggaa cttaaaaaat gttttattca tcttcttcct ccttggaatt
10201 actttctgta attgtaattt ctaacatatt attgtaataa tcattctttt gattgatatt
10261 atagttatca ttgtattcat taaagtctac ataaatatat tcatttgcgt cattttcata
10321 aataatatct atagctgtaa tatctgaata tgctgtaatc atttcataag cgttcgtatt
10381 atcaggataa gcaaaaccaa cttgaggtat ttccataggc ttatcaataa gaataccgaa
10441 ataagtacag tgacgtgttc gacttatact tgaagtccct ttatatgtac catagtaatc
10501 tataccttct gtaatacctg atatatggaa cctgcttacg tcttlaggct ctaatcttac
10561 aacatcgcaa ttctctaata ctaaatcaat atatttgata ttcattttaa ctctcctttt
10621 atattaataa ttttttccat tctttatcaa cctttttaag ttctttttta ttatagtccc
10681 cgtcttlagt tactacagtg ttccattgga acttttgtaa taagctaaaa ttatttataa
10741 tccatatatt actttlacta taatacatat tgtcttcaaa tcttatatct ttttctataa
10801 aatatttata tatttatat cttctttcat ctgcacctga tatttlaata atttcattag
10861 tatttaattg agtggataac tggaagataa catcttttac tttcaatagg tctttaacat
10921 tacctctgcc tacatggtca ttatagcaat catatttaac ttttttcttt tgttttctat
10981 cattaactac aatgaatata ttatatacga tataagcttt aaaatgggta taggtagtag
11041 gtgcttctga atcatcacat tcttttctta ggtctgtaca ttgtatttt aatgtaatat
11101 tatttgatat gttaactaca gtagagcct catgttttt attaagattt atcttatcca
11161 tttataatt acctacttat tgtagataca atgtactcga acatcttcca ttactttgcc
11221 taatagattc tgaccttcc agttactttg ctctaatatt ttagggtcat ttgctttaag
11281 acctactccc catatttat cataaggtga agctttctaca aaatctttac gtacatctgt
11341 gtctaatatt ctttgcttta ggtgtgtagt cataaattla tctttaacta ctctctaccat
11401 aatattatat cttactttat tccactgttc ttcattaaaa ttacgaactt tacgacctaa
11461 actttlagca tggtttgggt tcttagcatt tagtatttca cctgctatt gaaagtcatt
11521 aaagtatctt gctttgcgcc acataaaggc ttgctctgag ttattaaatg ttcttccttg
11581 gtgtttaaac tttataggt agaaattaga ataaatatcc tctttacccc aaaacataat
11641 atattccctt gttctctca taatatttct cctttaattc catagtgatg gtaatacaat
11701 tttaaaatta tctaatatttt tactttgtac ctgttcaagc tcatcatatt tatccatatc
11761 aaaatcatcc atttctttat gataatatttt tattaagctt aaaatatgtt ttatcatatc
11821 tatttgtgtt ctttctttgc cgtctacatc tacaaaagta tggtattcca tatccacatg
11881 attactactc tctataaatg cattlaggtc agcgtatagc tgaataaaaa aggacatgtc
11941 ataattccaa tacttaggtt catttctacc tagtttttc ttcattttct tatatttttt
12001 attctttttt atcccaaaaa cttcttttc aaagtcattc aatttaagac ctttaaaata
12061 ttttttcttc atttcttaac ctccaattta ataatggaa aatcaatgtt tctaaatact
12121 gcgccaacat cacacattaa catgtctcca ttaatttcta cttctccact gtctgtaggg
12181 gtgtgaccac atacataggt aaaaccatct tttctaggtt gaaagtctct tgaccatatt
12241 aattggtcaa ttgtttgttc ttctacaggt ttccaactaa ccccacctga atgagagaat
12301 atatacttgt cttctttata gtactttcta caattaacca taagtatttt aaattttcta
12361 tagtcgtctg atctttaag ttctttagt tcacttttaa taaaatcata attatttctt
12421 agatttttcct ctacactact atatttlaaa gttactgtac tcacaccgta agagttaagt
12481 gtttctatac aatatcttga gagccattca atatcataga tacttaatcg gtctacgttt
12541 tccataatat tataaaactc atcatcatgg ttccctaaca gagttactac attatcatca
12601 ttagacatta aatcaaatat atagttaaca acatctttg acctttlacc tctatctaca
12661 taatctccta aaaatactat tgtttcttca ggttttcttt cattatttat tttatccata
12721 attgttaata attttttggta ttctccgtga atatcgggaa caacgtatat agccatctaa
12781 tctcctcctt attgtatata actatcttac catactlagt aaaaaaagtc aataaaaaaa
12841 caccatataa attaataggt gttatcatt taatgttatt ttaaagtatc attaccatgt
12901 gctaatttt tatcatctat tgcatggtca ttataaaatat atttaacctc tatatactgg
12961 tcttcactttt tcagtgcatc tactatagaa gcattattag ttattgagct tgttctaggg
13021 taagtaaatt tttgaccgtc agataaaata atagtaacat caacttcaaa gttaacaggt
13081 agtctgtatc cataatcttc caaataatta ataaagttat taagagaaaa tggttttatac
13141 ttgccatcta aggtatagtc aatatatttca tttaatgcat tagtaagttc tgattctgtt
```

Figure 16 (contd.)

```
13201 aactccattg tatcataatc ttttcgtta tagaatacta caacattagg ttgttctata
13261 ctagaatctc cgtctttata cttagatata aaaaatccaa tatttccttt atgctctaaa
13321 taatctgctt tcataatttt aagtacttct tctgctatag gttttgctaa tagtgttacc
13381 cattcacctt ttctgcgtc ataaacacta ggtagtacgt ttaccatcat ttaaatctcc
13441 tcttcttaat ttattggttt aaaccacaat ttactcttat cacttggttc tgtttcacta
13501 actacgaaag agttagaatc aatgtttaaa gtattaaaaa caatttcttg tttgtcttca
13561 ttacttttg ttgtaaattc gggaacatct gttaatatag actctttacc attaatagtc
13621 catgatattt taaaagaccc ttggctatac actgtattcg gtgtcagttt ttcaattata
13681 attttagcgg atgcacctgt aattttttct gaagatttta ataatttacc tttggaatca
13741 tataagttta atgttctctc cacaaatttt atctccttta ctatattttg tacaattaat
13801 ataacaaaaa aacacctatt agtttaaata ggtgtccgac agagctcccg tacttagatt
13861 acggttaata atattttacg acaactatat gagaccctct gtcgttgaaa ctcttgtcac
13921 tgcgttattc cacaagatat tttagaaggt agcttgtgga agaagattgt ttttaaaggt
13981 acaattagcg tttttaagcc tattcgatac ccaggacact atgtccgtac taactattac
14041 gtcaataaag gttctacggt ctcaattacc tactctttat tgttaaaact aaaattaagc
14101 ttgagtgctc tagaagccaa aatcaattaa ttaactatag atacggaatg gagggggcact
14161 accatccgga gtctacggtc agatacaaag cctctgccgg gcaacatacg gtatctctcg
14221 tacatcaggt tgactagacc tttagagttt ttcactcctt ctcttataac cagtaactta
14281 agagaaatag gttttactta gtagatatga aacaataaat ccacatacaa tattaaatca
14341 tagtcaagtg attgcacata tgtctaaaac ctataagttt tttgctagcc tggtatatgg
14401 actctgcagg attcgaacct acagtcaaac cgttatgagc ggttggcttt accttttaagc
14461 taagagtcct agaaatatcc tgagagagga ctcgaacctc aacgactagg tagctacatc
14521 tagccaatgc cattactcag gattgctagt aacgctaaat agaattataa cgttaccgta
14581 gaccttttct acgcttggta gataggtaaa atataatgat ttcaaagtac ccatatagtt
14641 aggctcttat tctcattata aggttaaaaa ggctaactgt gttagcatt atataagagg
14701 ctttagttaa ctactatact aataatatac cataaattat acttaatgtc aagttaattt
14761 atcaattgaa tctataattt ttgatgtgct acgtatatct gcttctttac tatgtttaag
14821 gagatatttt aatttcatta aaaaagaatt ttttctttt tctataatat cttctttatc
14881 atcatattct gaaaacataa tgaattctat acctatacta tttctattat gtgaaaacat
14941 atttatagaa aaaggtgaat caaaattttt atcatcttta ttaatactaa agtcttcagt
15001 aacctgtaag tcatttattt cagatatttc aaagtaacca ttaactcttt taagttcaat
15061 ataactattg tatctaaagt aacgttgttc ttctattaac ttctcttttg ttatataagg
15121 atattcattt atgaatatag gattacttgt tccatagtta tctctaatat attctgcatc
15181 ctctagggaa tcagtataac ctaaaatttc ataacttgtt gtatacactg tatcttcttc
15241 ccacaagtca tagtccattt cctctatttc ttcttctaat atataaattt ttttcatata
15301 ttactcccaa acccgataa gattttaag cttagctata acctcttctt ctgtttgata
15361 agaaaatacc cctgtaatat gttcatagtt acctacaatt tcataatctt gtgtaccatg
15421 tttatctact aagtatgagt tattcataac atttaaacta tcttctgagt aactaaaatt
15481 tatgttatag tctactaaaa aattaataat attttcatt tacataacct ctcctatcgg
15541 atattgtcct agcattcttg ttccatttc attataaaaa gtatattcta ctacaataat
15601 atcatcata tctacatata tagcttctat atacggtgta atatttctt cttcttgtat
15661 gtgtttaccct atgatatcat ataataattc tgagtgtatt cgttatctc tcattataga
15721 cctccgtaag gaattctaca gttttgtctt tcaaagattt ttctactaat tccatagcat
15781 ctttatagtg tttgatatta gattcattag acttaagttt atctttact tcttgaatta
15841 ggggctctac tttattaacc aaatcttttt tctttcaat acttacattg ctctctctat
15901 tgtctaatac ttcttttggc atatattaa ctttgcaaa gtcttatag ctaacattta
15961 agttatctaa atcatctaat aaatcattat agtattctaa atgattatag aatgtataaa
16021 acttaacaag gtctttacca gttaattctc cttttttag tatattatta atattaccga
16081 taacagaata tgctataggc ttaaaattag ctctaacata agttaaaaat ataaaatcat
16141 cataaaataa atctaaaaca gttttattga atctagtatt tttagcttgc tctaattgag
16201 cacataaatt aagaacatta tcaaacccac ttttagaaac taaagagata aatctttcta
16261 ctgcatagta tcttgatact tctgtatgct tactgctt ttcattatc ctaaatatag
16321 tatctgataa aggttgaaca actaaactca tgtaatcttt atctgaatgc tcatctgatg
16381 ttccttgata agtacttcca aattctattg ttgataataa gaaactttt tctaagttca
16441 ttataacatc ctcctttat ttgttattta aataataaca tatattgata ataatgtcaa
16501 tacttatata tcttcttctg tatcaacttc atcttgttta tacttaaagt gttcatagac
```

Figure 16 (contd.)

```
16561 tttaaatagt ataatcccta gtgttattaa tcctaaaata tatttcatag caatcctcct
16621 taataaccat gtttagttac ccaccctgct aaagcatcca tagctatatc atattcttct
16681 tcattttaa ttcttataat tttctctatt tcttccttg cttgcttaga actaataaaa
16741 tcaatatcag tatcctctag gttagttaat tctaagtttt ctctaataaa attcttttga
16801 cttggtgtta tagaattaac tcttacattt tcgtgattta gaaattggta gaagtccata
16861 ttactcatcc ttttaacgt attctgccat atcttttaaa atacttagta catactctaa
16921 atctctatat tggtcatcta acgaacctat aatagcatat ggtgtcatat cccaggcatg
16981 tgcacagtca aaccctaata ctctcttacc ctcatagtca taatcatcgt aagtgatacc
17041 tctatgggca cgtcttcta aggagtcata ttcttttca ttgatatctg aaggtaaagt
17101 tatatatcca tttagatgac cagtttcagg gtgtctctta acagttagtt taactccttt
17161 ataataaata tcaagactta aatctctcc tagaatattg tttctttt ctacttttc
17221 cataatgtat tgaggtgctt ttttaaacat aattagtcat ctccttttta tttatatctt
17281 tactatacac tatttttat attttgtcaa caaaaaaagg ctactaatta aagtagccta
17341 aatattaatt atttagcgtt ataagaccaa cgccaataac catttttctg tgagaactca
17401 aagtgaaaac catcatagtc aaattcaata ttatagtctc catctgaag tggttttgaa
17461 tttagtacag gactattact ctttgccaat tctgctagaa actcatgatt tactttttcc
17521 atagggttta ttcctcctaa ttattcttac agtactaata tatcataggt cttttctaa
17581 gtcattttta aaagtttcct cgtaagaact agcgtaagta acctcataac ccactacgtt
17641 agtatatcct acatataatg actataatt agatttatc ttaatatctt ctgattgttc
17701 tagcttattt aagacttcac ctaaatcatc tgaagaatag tgttcattat ctattgttat
17761 tgtttaccct tgggtataga tatcaattc ttgtatcatc attcatcct tttgattatt
17821 cattattga ttataagttt ctaaatcatc aatgtatct gtatctgaac cttttactaa
17881 ccattctcct ctcttcttaa ggaggtcatc aaacttctca tgctcttaa ttatctttc
17941 tacctcactt ggtattaaca cagccctagc atagtttata tgccacatag acatattatc
18001 aataagataa ttaaccattc ttataatctc tttttcattt gccatatacc aacctcctta
18061 tatctattac taatataaga gaaaagcaga cttattaaaa gtctgcttct gtacctaatt
18121 ctaatcttct attttcata tgaggaatca tttttttatc tcctgttaat agagataatt
18181 ctctagcttt ttctttagat aatgttagta gtccattata attatctact ttactattat
18241 attgtctgac taagtactct agttcatctt ctatacctgc tagttctcct gattaactc
18301 caagtaactt tctatacatg tcataatctt cagaaagact ttctactttg tttttagata
18361 cagaatcata aactgctgt aaattaccctt ctcaataag tttaaaatta tattcaccaa
18421 tgattaatc ttttcagaa gagtcaaggg taactaaacc acttgtatta cctgtaaagt
18481 caccttata atctacaaca attccttcag ttatttatc tcctaattca atagttccat
18541 cttcattttc tttaaattta tgagcatcat aaactctac tttatcaccct aatctcaaat
18601 cttgagttaa gttatgttta ccaataattc tatccattac ttaacctctc ctttattaat
18661 agggtcttgt gttaagaaca tttctaagtt ctctttgta ataggtaacc aaaaatattt
18721 acttccgga attgtaactg tatagaagtc ttcatcatta ttaactttga tgttaacatc
18781 tgtaaactca tcttgcatta accaatgggt tacagttaag ttatatgacc catcactaac
18841 atatcctaaa tcaatatcat gtctaaaagc caaatcttct aaatgttcta ataaatcgtt
18901 cttttcatta tgtttttctt cttctgtatt attttaatt gggttaatta attctgtaca
18961 aacaatatca tacaattcac catctgtaac ctcatagttc ttttcaatta atacatcttg
19021 tatttattg attgaatttg taactacttt cccatattct tcttctgtaa acttacattt
19081 atctaaatca acatctgtaa ttaattctgc aatccattta ttaaaattg atactgccat
19141 tgttcgagaa ataatactat cgtataccat atttatttaa tctccttatt taggtgaatg
19201 tggtcttcta atgaaaaatc aaaaggcgct acaccattc ttttattatt tgttttcttt
19261 ttaagtataa cataagttag tgaaaaagtc aagatagtta ctacaaccat tgataaaagt
19321 ttaatcaggt ttttcatagt tactctaact ccttaagttt atttttact ttctctttat
19381 cgtacttata atctttacta gagtttcat tttttcttt ctcttcttca ttaagttctc
19441 tatactgagc ttcttctacc tcttgttctt tattatcgtt atcttctct gcttttgaa
19501 tttctacatt cttactacta ccattacct tttttctaaa aagaaaccaa agtattaata
19561 aaatgatgag taaaataaca atgctcaata caacagccca aatattatta gccattacaa
19621 cctacctccg aatagttttt ttacagctct taagtttca gatgaatcgt tatttatatc
19681 aattcctacg ctagaatcaa aaattacagc attatcaagt atatgctctg ttaattatt
19741 accataacta cttttactta ccacactacc ataaccatga ttagttaggt caaccatatc
19801 aggttcaact tctagtactc taaaagatat tctacgtaag aatgaaggat ttactaagta
19861 aaaggaagat ttaaaaacat ttaatctttg ataagaatgt tttatattaa caacaaaccc
```

Figure 16 (contd.)

```
19921 tgttaactta tcttcatatc ctgaatttga taacttacct aagtaaaggt ttatactata
19981 tcctttgtt tctaatgttt gaatagcact taacattata gccctctgt aagcaagatt
20041 ttcagggtct tccatccaac taatactaga attataaaat acatcaataa cttcttctc
20101 tgctttaact cttgctgag acatcataga attaggtaac cctttatag cattaggtac
20161 gtgaggtga taccttccg gagctacgac aggttttctt tttactgact tatccattct
20221 aaataatgca tctgtcattt ttttaagttt aactaccata tcatatgact ctctatcacc
20281 cttaaccatt aagttatagg cttcttgaaa actatgagtc cctgtaaaat catagctacc
20341 tgtatctgat gaattatctc tacctgaaac tctattctt tttaaagcag aaaagaaatc
20401 aggtagacca tcatatttaa ttacatttaa ttctgagtta tctattaatc gtctacccat
20461 tgattttcct cctattctaa tcctaattta tccataattg tatcaaagtc cattgaatct
20521 tttgatgtac tatcagattt tctaggttcc tgcttaggct cttgttgcat acctaaaagc
20581 tttcttgttg cttctgtgta tctgttaccc tcaggtaaag agctaataaa ttgattaatc
20641 tcatcttcg gtacagattt aaagataata cttctacaa caaactcatc ttccattact
20701 ccatctaatt tactaccatt aataatgca cgcattgaga atacataagg taatcctttt
20761 tcatcattct catgtcttaa tgttgtaca aagttaacta ggtcttcatt gcttgataac
20821 tgatgttcca ccttagtatc atagtcaaat tcaacttgag caaagcggtc taatgtagct
20881 ccgtctaatt gttgtctacc tacataaata tggtctgctc ctgttcccat agtattacct
20941 gctgacacaa ctctgaaatc ttcatgagct gttacacgtc caatagggaa gtcaaagtat
21001 ttatttgcaa tagctgaatt aagaattaat agtacttcag gaatagatgc atccatttca
21061 tctaagaaga ataacccacc ttttgtaaat gctttataga attgggtttc atgaaactta
21121 ccattgcat caataaatcc tgttaattta aattcttgag taattgcatt actgaaataa
21181 aaatctaaat ctagagcttc tgctacttgt tctaatacat ggttcttacc tgaacctgct
21241 ccacctttta aaaatactgg aatatttgg ttaactaact ttagtatatc ttggtatcta
21301 taatggaaga ttcctgagat atcttttaatt gttttttcct tcttgttgta attcaattt
21361 aactggtaaa ttactaagtt gttcttctac atattcttca atttgttttt taacgtcagt
21421 aataataatt tctctactct cagttcctgc ttctcaaaca attgcatcta caattgcttg
21481 ttcatacgga ttagagtttt tctctcctag tttgtctgcc aagtcttttg ttgtttccat
21541 ttgttgttct accaatctct ctaatctttc aatagtatct tgctttgcca tattatcat
21601 tctcctttga tttgttatac atttattata ttacaagtat ttgtatttgt caacaactttt
21661 ctaaaacttt ttttagttgt taataaaaaa aaataccctta cacctataac ttaacatagg
21721 gtaaggtaat tgtcaacact tttattaaaa atacattaat ttaaaaaaat catcaatatc
21781 tttagtttca tgtgtatcca tatcatacat aaacatacaa ttatatgtat gattattcat
21841 tattttctaac atgttatgca tagaagttgc attattgaat tcctctaaat caatagttac
21901 cgtaagttct tgaccttcat aaagtatgtt tgctatataa tatttcctaa cacttccat
21961 tgttccatga gaagtttcat tatgattaag tacttctaca cctagtgaag gtaaatattc
22021 tgaaaagtaa tatttacaga atatataaa attgtctgtt cttttagaca cgagtactat
22081 ctccgtactt tatatttctt tctaatcgta cataatatgt tttaatttt tgtacttctt
22141 tatctactgc atccttcctt cctaaccttg tagtatattt tacaatatta aatatcatag
22201 aatcaacaaa gccatcataa gaaaaatgtt cttctagaaa agaaataaca tccttactac
22261 ctttatagtg ttcaggtaaa tgtgcatcta cttgtatatt ataataatct tctaaaagac
22321 ctataccttc accaagacta gataaagcgt aacctaaatc atttgaatca ttagaccatt
22381 ctttagatac tgatagtgca tcttctataa ttgttacttt taatttatct aaataatctt
22441 ctactgagc ttgtgtttc ataaattctt ttgcgttcat gtaatacccct cctaaattat
22501 ataaaaaaaa acaccctgct tggctacaag caaggtgaaa aaggaaagat attatggaag
22561 tgtactatct aagtacacct cataaatataa cagtttcct tgctagttat tacttattt
22621 ttaaggtctt cttcttgac aaacactcca ttaataagct tacctttct gtctttatc
22681 tcatcataag ccatatcaat acactcttca atatctatat ctaactgtaa acatagtact
22741 gttaatacta caaaaatatc cccaacacta tctcttgtta catggtcatt acttttagca
22801 atacctgaag ctaattctcc tgcttcttct aataacttta acattgacc ttcaggttta
22861 cctgtttgta aattctatc ttttgcccat tgttaataa gttctacttt ttccattatt
22921 ctatatctcc tttaatttct gtatctttga taattaggtt atcagagtca cttgttacat
22981 ttaaattatc ttcaactaat tcatgtagat tattagtaat atcttcttca tacctataac
23041 ctacacgaac ataagcttta actctgatat ctatattaac ataatcttct tggaatttt
23101 ccattctaa cttccttat tatatcatat tatgtatacta ttgtcaatta atctgagtag
23161 tttccttag caagttgata cttttgtgt aattcttcat ataattctct cataccttca
23221 tagtttctca tatcatcttc caagaaacta aggtaatcta ataatactt tacatcctca
```

Figure 16 (contd.)

23281 ggttctaaag ttataactgg ttttaccatt aggcaacctc cttaaattct tctttattta
23341 ttttcttgat atcttttct aatgcttctt ttaattcatt aggtaattta taggcatcaa
23401 ttgattgttg ttgacctaat acataaccat tatctgtaat acgtatttcc actgtaaacc
23461 atgaattatc taaatcttct tctaatcttg ctaataatat taaacaacta tttttagaa
23521 ttctgttagc atacccacca acacaatgag ataacatttt accttcatct ttaagtttac
23581 ttacagtatc tgcaggaagg aattttactt ttctaccatc ttttaattta taagttttat
23641 caattatttt ttctaattta ttatcatatt tagctttaag ttctgcatca tctaattgtt
23701 gttgtataga ttgtttctca tctgtaacta tatcatgttc tagttttagt gaaaatggtg
23761 ttaaactaac actctctaat gttctataac cttctcttat taatattgat aaatcatgta
23821 agtaatctaa gtaatagtta tctagtgcat atcctgttat acgttgtctg tcttgagcat
23881 ctacatctaa atagtgcgtc atcttttgt aattagcaaa agatatagat aatatttgat
23941 tcacaatagg tttaacttt aaagcatctg taacatctct tgaatctcta accattaaaa
24001 aggtatcgtc aaacaattgg tgtaaattaa cttcattgtg taaatgatta tagtgcttat
24061 agagaatatt agcaaatctt aagtaattac cttgctcaaa tttatttaaa gttagtaact
24121 ttttataagt ctgttttgta agattgaagg cttcatgaac tttccattta ggttttttag
24181 gtatatggaa tagtaatgca tttcttcaa ataacccaaa ttcttctaag ttatttattt
24241 tatcaatatt tttaacaata tctgttaaag ttattaagta attagaagtt gaattttctc
24301 ctataaaaat cctatatta tctcctctat aatttatatg accataaaca tctgtattat
24361 caggacacca actagaaaaa tcaaaattat ggtgctctaa tgtttgttct attatcttta
24421 ttataattcc tctagttaag ttaggttgtg catagttttt taaaataaca tttaataaaa
24481 cagataaagt taattcattc ttatattcac tttactaat atcatcttta tataggttta
24541 aagttatttc tttattaaca agactatctg ttaagaaaac cttaacttct cctgttttaa
24601 cgtcaaatga actttattt tctaaaaccc atttgttacc catatatgt ttatctctaa
24661 tatgtttaac tttaagacca aaagatgaat agttttcagt acttggatgc atgtaccaaa
24721 cacggctata taattcatct gtcatagcac tatagtactc actagaacct ttttctatat
24781 cttcattcat aacaataata gatgacttta taagaccata tttaccttgg tctagtacat
24841 ccataaatatc attatttaaa ctatctacta cttttttata ttcttctaat tgtctagatt
24901 cattcctcca taaatggtca ttaccttcta gttctttaat tttttcttca acataacctt
24961 ttgattgtat acgtcttcta ctcttataac catatacagg aaaatctttt cttcttctc
25021 tattagattc aatatactct ttgtaacttc ttcctttatt atcatcaact acaccttcaa
25081 ctaattttc aactgtttca taagggttac cttcaaagtt tgttacttct ttattaccac
25141 atagggctaa aaataaatgt atttctgtgg ctgtatcaaa actaaatata ttatgaatat
25201 ctctaaataa ttctttagaa cctaagttaa ttatattatt ttctttttc ttaagaaata
25261 catctcttc tcctatatag atacatcctt tattaaccttt aggtaaatta ataatttctt
25321 gttctgttaa tccttttgt ttataagtta ttgccattta aaatcactcc ttattgtta
25381 tgtactaatc ataccatagt aaataatatt tgtcaacaaa aaaagaagaa cttttaaag
25441 tccttctaaa tgagtttcgt atataacttt ttgaatttta tttaatgtt ctaaatctaa
25501 attcataata agttttttat acttcttga attttaaaa ttgatagtat ttggcatagc
25561 aagagcttca tcaacatctt tagtatagct tacaacatct gaatagatat ctacttcttt
25621 tacatataga ccttgagtta aactcctaaa tactacctca ttatgtgcta taacttcttc
25681 tttcttttct atgctcattt ataaacctcc tggtctactc tacacaaaca agtacgtatt
25741 ctaaattagt taaagaaact gatttaatat tgtttaattc ttgtaatttc ttaatttcca
25801 catcatagtt cttacttata gtccataatg tctctcctgc tcttactttg tgataatatt
25861 tatttccctc tttgataagg tcattcaata ttacctaccc ccttgagtaa taattagctt
25921 gtagataaca tataagtata agaacaaagt ttacaaattc agtagctata atatgaacat
25981 aggtatgtgt taaaaccata cttacaatta atgaagctaa tcctaatcca ataataagaa
26041 atagaaatct atttgttcct tctgcacttt tagttttata aaaggttgtt atctgagtta
26101 catacgcaag gataatagta atagttgcta cagtttgtgt taaggctgta aagtcactta
26161 ataaaaatag taacagtgag aacacaataa taaaggtat agagaaatag tccttttttc
26221 tatatgaagc tactaataag caaacaatac ctaaggttaa attaagacct acagatacta
26281 tttgaaatac tgaagcatca gttaataata agttgtaaaa acttatacct actgtagcta
26341 caattaaata ccaaaaatag ttactaaactc ccttgacact ttctgcttta actaatgcta
26401 ctaaacctgg tatatatcct actgtaatta atatagcata taatatactt aagtaatgtg
26461 ataaattatc catctgttc ccctaatttc tctaatctat taataacttc ttcccatgaa
26521 ataaatcctt ctccgtctgt tagttctaaa accataccat acacaaattg gttcgtacta
26581 aattcagctc tgtcagggtc attgtatggt ttaccatgtc cttgtctaat atccgagcag

Figure 16 (contd.)

```
26641 tagattaata cgggtttatt tacaatgtttt tcaagtttat ctactattaa ttcttcttca
26701 gtatttaatg acgtttcaaa cttatttgta aaataattaa aatactcttc tccattatca
26761 tatatatggt taattgtttc ttctgcttga tgtttcatac ctaataaaat accgagttct
26821 gcaattgttc ctaatccttc attaaggata tcaaatacaa aaatatctga ttcttgcata
26881 gccttaaagt cattagttaa aatacgttct gctagcttag tttgttctgc attagcttta
26941 tcatttattg acttatcttt gtgagggcta taaggagtta ctcctacaat gccatctact
27001 tctttatgtt gtttatctct gtaatctacc atagcttcat ttaggatatg tccaccata
27061 taaattactt tgtctttaat tttattaccc atctatagta tctccttttt cttctaaaat
27121 ttctcttaaa atatgtggca tttttttctt aatttgttta tctactattt tcagtatatt
27181 ttcttttttct tcttccataa tatcatcaac aaagttttga cctacttgtt tcataattag
27241 accgaagttt tctaattcta aatcatcttc agataatcta tcttcttcta tagccctaaa
27301 aatcattttt tccattcttg ctcttgtaat ggcataatct gccactgact cgttctttt
27361 tacttctgtt ttcatttttt gacgactaaa ttctttaaac tcattagata ctaatttaaa
27421 gtagtcatca tattctgatt taccatctaa gtatttaatt actataccttt caccctttatc
27481 aggtttaact gtcatgtcag attttcctac taattcttga atttcttcag gttttaaatc
27541 atttaagtag tgagatggtt tagatactag caaagtttta actgttttta accctaaatg
27601 atgtgcaatt acattcatgt cttctactga taaataaact tcatttctt tatcataaac
27661 atcaaataca taaaaattgt tgtaaaattc ttctttgtac tgaatcttat gtttgactaa
27721 ccattcacca aaaataatgt attttttctaa ggctgatacg tacgtatttc ttacatttat
27781 attttcatgt acccaatcat aaaaaccatt taaagtttca ttctcattta attttttct
27841 acgtgaaaaa catactaatt caccatttttc tactgtgaag cttgcattac ttccatctaa
27901 tttttcttgt acaactagac ctctttcttt aaattttatct agtacaatac ctttattttt
27961 tactttagta tacgatttca ttaattatcc tcctttgaat tatgtactat agaaaacaaa
28021 ataagactta cgcttgctaa aaatgctaat actactaaac caggtaaatt taaaactgtt
28081 gataagaata atgatattgc acttataaca taaactagac cgcttagaaa taaagttaat
28141 aatacaattg ttataagttt caccaaccaa ttgttattaa taaataccttt agctaaataa
28201 ttcataaaaa aatcctcctt agttattata gaataattat accataacta agggggatttg
28261 tcaacatatt attttaccat ttaaaattat ctgcatattg tgcaagctta gagcggaaat
28321 taactgtaaa attatgaaat actgctcctt cataatttt aaagtattcc atataatctc
28381 caaaacctga tttactttcg ttcttaaat ctattgttt aaaattaccct tctactatta
28441 cagtagaatt tttgtatga acccttgtaa gaacttttt aagttcacta cgtttaaagt
28501 tctgtgcttc atttataatt atagtagcat ctcttagatt tccacctctt aggaatagat
28561 gggatatttg agatacccaa caatctccta gtttatcttc tttaacatta tcttccatca
28621 ttaacatttc agttatttgt tgttcaggat tcatattaag ttcaataagg gcatcatgta
28681 atcccatgaa ataagccatt tcttttttctg tctgattacc tggtctgctt cctaaatctt
28741 ctgatactgg tgaaattata aatactagct ttctattttt attaagatag tctgcgtaag
28801 cacaggctac tgagcacatt gtttttacctg taccggcttg actctcattc caaagtattt
28861 caacattatc attaaagaaa tcctcacaga aatctaactg ctcggttgta gcttttttcaa
28921 ggaattcatt aaagactaga tgtctcccca tgttgtatct tacattagga taatctttta
28981 acttaaagtc taactctttt agttgtattg ccatatttta aagttcccct atctataaat
29041 agttttactc tcttttaata tagtactaat ttccgatata ttctcctgtt gaagagcaat
29101 aattactaca ttcacattca gggtagttat cacaaacatc ttcatcttct acatcatcat
29161 aaccaatatc ataattatta taattaaaat ctacaataca attttcacta ttacctttag
29221 ataatcctgt ataaataata tcatccacag aatcccaatc gttatctgcc aagtaattta
29281 cactatctag tactgattca ttatcaggta aataaatact accgtctgaa aatttaatta
29341 aaatatcacc ttgaggtaag gtatccattaa ttaaatcaat ctctgtttct tcttcaatag
29401 tgaatacagt tccttctaat cttccggtg tagtatgtgt taaatgtttt acagtatccc
29461 ctgattcttc atagaatcct actgcattca tatctttatt atattttgca ataaatttac
29521 cattgtcact taccaaatat tgactagttg cattatagtc gtttgcgtca tctactgtca
29581 tgcaagggtt ataatcttta acataataac taattttcct aacatctgct gtttgtactt
29641 tcttaccttc accttttaatt actgaattaa ttttcttcat aatatttctt ccttttata
29701 tatcaattga ttttttttgca agattatcgg catagtcatt ccattgtca tttgaatggc
29761 tctttacttt tacaaagttt atatctatta cttttttggta ttctcgtatc atattaatat
29821 atgttttact tagaatattt cttgcagacc aagtaccttc ataccaatgt attaaaccaa
29881 tataatctat ataaactatt gcctgattgt atcctagttt tatagcctct tcaataccat
29941 aacaacaagc caatatttca cctgcaacat tattatactt tattaatcct ggtttgtcaa
```

Figure 16 (contd.)

```
30001 cactttact aatttccgat attatatttc cttctttact taccaagaca gcacctgagc
30061 ctacttacc tttattatat gaggagctac cgtctgtgta tatatttaca ctatcctgca
30121 tacttataat cctccataaa ttgagggaat tcacaatctg aatagacttc tctgcaaaaa
30181 gatactgaga tatagttaaa atcaaaacat ttgaaacagt gttcttgaac ttcttttta
30241 tctttagcaa tcacattaaa tttaaaacca tcagctatta ctgtaaatac tccttttc
30301 ataaaacaaa tacctccact aattttattt taaattaata actaactcaa taaatgattt
30361 aatagtttta tttttacctt catccaatatc tgaaaagaaa ttaattaaac tgtcatcctc
30421 atcaaataaa tcttcaacat catccaaattt atttaatatg tctgtaacac tgtaacccc
30481 ttctgatata tactcatgta agtctctcc atcttctgac agtgttgctt ctattttacc
30541 attttactt tcaattaaat ataaagtatt taacacttta acagaatcta caactacact
30601 gtagttacta atagtaggat actctgtata aagtatttct acattagtat tcatataact
30661 atcaattaca gagttaactg tatctcttt tagctcagat acattatgtt ttcgtatagt
30721 aggaaattct tcatcatatt ctactaattc ttttctatct gtattcaata actttgtctaa
30781 agaggacaac aatactatt tatattggtt atcaggaaga ctgtctgtaa ttccattat
30841 tgttaaaaac gtatcttcac ctagaacttt gttttatatct tgtaattcaa atgaatctac
30901 catttcaata gtatcatcta tatcatctgt agtcattaaa aaattaacta aattattatt
30961 ctccatcgtc ttcctccaat tctttaaata actctttcc tggagtattt aacgctttct
31021 ctaaccgcat taaattagca cttcttggtt tcttttcc atactcccaa taagatataa
31081 gagagtaatg aacacctatc tcagaagcta gacttcttaa cgtatgtcct tttctactc
31141 taatttttg aaggtttaga ggttacttt ccttttttc atccataatt atttctcctc
31201 tactttaaa aatttaaaat cctcagatgc tttgcattt tttagtatat actcttgtga
31261 tttatttctt gcctctgcct tacttttagc ataaactct atatgaaata catgaggttt
31321 ttaaaagac ggtgactcgt atctccaata aactttaaaa agtagtgttt cttttttaa
31381 aacattaatt cgaaaccatc ttttaaattt atttcattcat tatcctcctc tatttatttg
31441 ttaaactaat tatagcatag ttaacttatg aagtcaacta taatatacaa aaaaagacta
31501 agaaattaat cttagtctta atatattaat aactattatg tgcgttgtgg tatgcaagag
31561 ctcctgatgt tgaaccgtaa cggtcaatca tatattgtt tgcaccttta gtttgttctg
31621 ctatagaacc accactccat gatttaccta atccttggaa taatccttga gctcctgatg
31681 atgcattaac agcattaggg ttcattgtag attcacgcat agcaatttca atcattgcct
31741 cgtctccacc tgcttgtcta atctgttctg ctacagagcc tcctgtagaa ctagttgatt
31801 gtgtaggttg tttagtttcc tttgaactg gtgctgatgt tgtttgtact tctttttag
31861 tatcttgttt atttgagta tcaaatgtg cttgttgttg gtctactttt tgttcaggtg
31921 tttgttcttc tcctgctaat ctagatactg tattatctac ttgagttgag cctgaatggt
31981 atcataacc aaagttacca ttataattat agaaatgata agtaaattca ccatcactaa
32041 aagagaaatc ataattacct gcttgaattg gtttgtatt tacttctgct gaatttgatt
32101 tagcttgttc tgctaactta ttataatcaa tttcgtctgc actagcttca tttgtagcaa
32161 tacctccaaa agtaatagct gtacctaatg ctaatgttgc aaaaattgtt ttcttcataa
32221 atttaaaact ccttaaaataa ttttttagaa ttgttattt gtaaaccgac ataagtaatc
32281 ataacatata tctttaaata acgcaagtat aatatagcac taattagtgt aatattatta
32341 aggtttatt acaaacatta cagttatcag ataattaaat acaaaaaag agaggtaatt
32401 atatttacca ctctccagtt tcattatatt tatttattac attatctctt aattctatag
32461 cctcttctaa agattttgca ctaaaatatt taacttatt tttcttaca atttgtatat
32521 tatatacatt atttgatttt ttgtatatat tatgtgtact tttctttctt atattagttg
32581 agttttcaga cctagtagac cacttaacat taccaggttc ataattacca tcattattta
32641 ttctatctat ttgataattt tcattcggag ggtctcccat atagtcgtag aattttaa
32701 aatcattctt ccattcttca catatttcta tacccctcc tccatagttt ttataattta
32761 tagcgttaac atcgtaacaa cgctgtttca tacctaacca tcttggtac attgggttac
32821 tggataatcc atgggtagta ttcctttctc tcattaactc actatgaatt ttattactct
32881 cacacccaca agatttatt ttaccttgcc ttaaagtgga gcttctaact attattactt
32941 ctccgcattc acataaaacat tcatacattt tacatcttga tttatccctc ttactagact
33001 cttttataac ttttagttta ttaatagttt ctccaatcat aatatctcct cctataataa
33061 aactatagca taaaaaacca cctatgtcaa taggtggtta aacatatatt ttatttaagt
33121 ttgtaataac actatctgaa cctatactaa taggttgttt tccattccat tttcaatta
33181 attgttgttg taaaacttcc tctgttaagg attcacttct aatgtcattg gctttctttt
33241 cacctttgc ttcaattct ttcttttag cgttttcttc tgctattgc ttatcaactt
33301 tagtgcgctc tagttcttgg tttgcttta ctctctcatc aattgctttt tgagtatttt
```

Figure 16 (contd.)

33361 tatctgcagt tgggcttgat aatgcaatat catcaataat aaaaccttgc ttttctaaat
33421 tatcattaag tttatttaaa gtatcttgtt taatttctcc tgtttttaca ccaaaagcat
33481 caattacaga gtacttagaa attgcttgtc taacattatc ttgtactcta gaacgaagat
33541 acccttttc aagttcttct atgtcagcac ttccgaatct attaaaaagg tttactgcct
33601 tagttgcatc tactttataa gatacatcaa tgtctaattt aatattttta ccatctgaag
33661 ttgctacatt taaatcttta tatttatgtg tttgtgtttt agtigggtat ttatttacct
33721 tatcaaaagg tgctgttaaa tgccaacccg gtgatttagt atcttccita acaccattta
33781 ctgagtatac aactccaaca tgaccttgtg gaatcttagt aatacacatt aataaaataa
33841 taaaccctat aattgctaaa aaccctaata ctcctgaaat aactactgac tttctcatta
33901 catttctcct ttttctattt ctttttattaa gctatttaaa gcttttcct cttggtctat
33961 ttcttgttta tcggctctag ttacaattga ttgtctacgg tcatttaaga attgtttttt
34021 atactttaca tattgttcta aaccgtattc atctaatgta ccttgcctaa ctaattccct
34081 gtattgtttt cttatgttac tcttcttctc tttcattgaa agaaaatcaa ataaataact
34141 tataccaaaa cctacaagga ctagaaaaac aataaaaata gcaaaatatg ttaaaagtag
34201 tgccatgtaa ttcctccttt atttgattac atatataact atacactatg tatttaattt
34261 tgtcaacact tttttgcaaa aaaaatagac ggattttaaa tccgtctaaa tttatattct
34321 attigaatac tcccccaggca acgccaggta tttgattagg tggaacacct tgacaagttc
34381 taacagggca atatactctg ttaccgttgt aagcattata acctatccaa atgtgacctg
34441 cttggataca aacttcgtca tatacaattg tagcccctgc cggtaagtta ccgcctactg
34501 gagcatttaa gaatggagaa cctattctag ttactatagg ttggttacca ttgacaaatg
34561 ttgcattttc cggtttatac caagttccgt actggttctt ttccaagaa cctgtaactg
34621 gtctagttgc cggtgtactt gcgctacttg ttttaccatc tttaactact gtagaacttg
34681 aagttccttt atccatgtag tttttaattt gtttaatgaa ataatctttt aatttattca
34741 ttattgcttg tgatggtctt cctgtgtta ctggattaaa tcctgtatga agaaccatag
34801 aacggtgagg acaggcagtt ggtacaaatt ccatatgcaa tcttacagtt ttacggttag
34861 gagtaagacc ccattcttta aatttctctg ctgtaaattg gaatactgct tgttcatttt
34921 taaggaattg agcatcacta gcactcattg attgacagac ttcaatacct gcaaatctaa
34981 agttacctga gtttgctcct gttccatccg attattcaat aaaagacgta actcctttac
35041 cggttctctt atgaactcct tatagtttcc tataagacta gactatatct tcaccctaat
35101 tttgttaggg gttctccatt tcgatttaag ggattctcac ccactccatt aacttgagcc
35161 ctactcctat tgacgattta tttttattgg cactcgtccg agggatagtc gttgaaccttt
35221 aatattgttt ccaaatgtat ccgtaggctg ttttctctc tccttttgata catcttccta
35281 tattaccact tctttatta gaaatacca agaactctaa agcctcttga gctgtgtaaa
35341 agacattcaa taaattacct tctaagtcat actgagctat attataattt atttcatttt
35401 ttaatcctgt cttattgca tgttctctgt tctcggaatt agaaacccat tctaaatttc
35461 ctacactatt atcatttta ccatttaaat ggttaacttg ttctttatta tcaggattag
35521 gtataaaagc catagcaact aaacgatgta ttttaggtga atggtatcgt aaccttacaa
35581 acaagtaacc cttgttattt tttgaagtt ttaactttt aggctcttta ccttataag
35641 atattacttc tcctttatca gtaatagtgt aatttcata tattctaat ccaggtattt
35701 catttaattt ctttccata ataacatctc ctttacttaa gtatatagga aagttattat
35761 gttgtcaagt agttttttaa aacaatattc ttggatgctg attagcatag cttgatagcc
35821 ttagcctccc agtcaattaa aagaacttc attatacatt actgtataac agggcaattt
35881 attaccegt gtgccaagca atttgatct tagcatctat tgcttcccat acataacctt
35941 cagagccgta gtaatgagca ataccattag cgtatctagc ataacctgca ttagctaatg
36001 aattctcgta ttgttgtcct gaagaacgac ctgcatcgtt gtgtattacc attccttcag
36061 gttttttacc acgtttatcc attgtatagt taatgtgatt cttagaaact tttagtgttg
36121 ctttctttt aggtgcaggc gtttacttg cgcttttctt agctgtttct tttttaacag
36181 tagttcctgc ttttacaggt atttcaatga agtgagttaa tccgtaataa ttatctacac
36241 gttttgtagg tttttttatta gcataaccat tccagttttg ctctaaaata gtaaatgtag
36301 aagtattacc tccatcatat acaatacct tgtgaccca ctgttcataa ctaccggatg
36361 taaatacccgc aatccaacct ttttaggta cagtagaagg tttatttca tgtattttaa
36421 atccagtacc ataactctgt ttaatttggt ctttagcatt accccaagtt ctaacttttat
36481 tatctgttaa ccataaaaca tagtctgtaa taaggtcttg acactgagcg tgatagtaac
36541 catctgcatc aatggctcct gcttccatta caccaaatga tgggtcataa cttgtagctt
36601 ttttaactct gtaagggcta tctactgttc cttttgcata agcatctaaa cgtttattta
36661 tttctgcttg agtcttagcc attacttaac ttcctcctct gcaaatactt taccatgttc

Figure 16 (contd.)

```
36721 ctcggtatct tcttcatctt gagaaggtgc tgaaccacca tcaatttcat cttcaatagc
36781 aggtacttca tcactatcat ctgtgtcagg ttctgcattg ttttcgtagc tgtctatctc
36841 aaaagtacta gtgttatttg catttgcttg ccattgaacg aattcattag ggtctttact
36901 atcacgaggt ttaagatagt ctgtttgaac aatatcacta tctttaagac cttagttatt
36961 attatcaaca ataataccta aacctgctaa tagtgttagt atagaaccta caatatttac
37021 accttgctca atttgagctg agtagtctaa accgaaagca cctataattt ggttagcaaa
37081 taatgctact gctgatataa ttgctaccca aaatgttttg ctcttagttc ttgtgctaag
37141 gtttattcct ccaacaactt taggttgttt agtttcatta gccattaaaa aaccgacctt
37201 tctattatat ttatttctaa caataatata acagtaggtc ggtcatgttt atctatatta
37261 atttaacact tactcattaa tttggtttag tttttgata acttcagaca tttgtttgtt
37321 atctaaatct tctaatttag tttcaggaag tagctctaac ttatcccaaa ctcttcttt
37381 attagatact ttattattaa taattgcctt accaactaaa ctttccgtat aatataattg
37441 ttttgctgat gccatttgta tctctccttt taaatatgta aagtatatag ctagtatcgt
37501 atcctaggaa caaacacttg cgctatatac tcaatgaaat cctaccctca ttcgaggaca
37561 cagcaaaccg gttcgtcaac cgcacatatg aattctcaga tttcatttat gtaaaacaca
37621 ccctcttga tttgcacaaa gactaagggt tttggagacc cttgtactac taattatact
37681 aagggtgttt attatggttt ctattggatt tgaaccaatg acacctagag cttcaatcta
37741 gtgctctacc atctgagcta agaaacctta aaacgaccca tacgagactc gaactcgtac
37801 tctctgccgt gacagggcag tgtgttaacc agttacacca atgagccaaa attataatgc
37861 tataccctaa ccttacctta atgtatagca ggttttata taagctcgaa gcaacgatta
37921 ttaccactca taacaactat atattaagtg aaaggaggtg aaatgaacaa aacgtggtaa
37981 ttggtactta tataggaaat atgtataatc tacaaggagt aagttattga ttcataaagg
38041 agtgtgaaca ataaatacat gaaagagtga aagtttactc cctgtagatt cttttttaa
38101 ttatcaatca aaggaggaaa ctgataattg ttaataataa actataaaga ggaaaatatt
38161 tatagtcaca ttctgatata atgcaactaa atatccaagc ataacccgtc tcacgaggaa
38221 cctacctata agacctgtta ttaagtgaat cactacgatt gactctatta aggagctacc
38281 ttaagtccat ctcacgcaat ttaaaaggga cttacaaacc gtaaaacggt aataagttta
38341 ttaaataatg tgatattaac atattagtta ataactttca catggtcgaa gaaaagtaaa
38401 tttatttgat taccaaatta tttttatcaa atatagctct tttgaacctg tagatttatg
38461 ctacttatac tgataaccte tattatctaa cacatttctg tgctccaact acagttagtc
38521 gttacagcgt atcttctag gattccgcta agaccctaaa aagaaattaa accctagccg
38581 ttatcatact ctacagacct tataagtaag taccaagtat accaatcgta tttaacaata
38641 ctaatgacga cccatcctac cgatatatct ccgataggtt ttgattcgtt tgattatctt
38701 gtaccttatg actaccaaat cattattcag tcactatgct cagatattta gttgtattat
38761 ttatatatta attataacat aattttttatt acttgtcaag ttaatttcaa aaaaattata
38821 gaagtaggga cgtttaccta cttctattta atttacacaa ggatgataac attgttattg
38881 ttttatactg gaaaacaatg taataaaaac agtgatgtgt aaggtatttg tttattgtt
38941 aattatatta tagcatatac tgataccctt gtcaagttaa tttaatactt ttttaaaac
39001 attagttatc ttttgttagt tcctcctgaa tagcatccca tcttcttct gcttcactac
39061 gattatcttc tatatgtttt gtagttttac aacatttgat acaatatata tctttgatat
39121 gaccttcttc tctttattt gctcttttc ttggtacttt gaatacattt ccacattctt
39181 tacatattaa acttgagtaa aacattttt gtctttcat aattaatcaa ttcctttct
39241 cttttatttg ataatttaac tatatactat attgataaat aagtcaacag ttttctaaaa
39301 ataatttaaa ttattttgaa gaatacttta atatcaaggg ttacaagaga aaaagtacgt
39361 atttagaaaa taaggagtac tcctattata tataattata ttctgatata gagtaataaa
39421 taatattaaa tatataatta taattaataa ggttgggaaa attgatataa acataactga
39481 tactgcttat agatactcag tataaaagta aaatccctta gtatcagtac ttacaggcaa
39541 aaaagtacgt atttagaaaa taaggagctc tcctattata gttatatata tttattacta
39601 ttattaatta ctattaaat atataattat aattaacaat gttagaaagt caacaatagt
39661 ataaataaaa aagtgactac ttaaagtcac tcaataatta gaatactatt ttaaaagatt
39721 ctattctgtt tggattaata tatacttgag gtgaagttat agcactttca gtatatactt
39781 ttatagaggt ttcatccatt cctcttaaca tataatctat atcttgccta ttgtaactct
39841 tttcatcagt agatactaaa aagtatttag ctccacttga cattgttatt tcaatatgtt
39901 ttgacatcta caatctctcc tatgcaaatt tgttaaagac aaaggataat atagctccta
39961 gaacaagtaa aagaaccttc tcagttgtat ccttttctt agtatcctta gttttgtac
40021 tttcagcaag ttctgaaatc ttttcatcaa gtcttctaa ttggacgtaa attgctgatt
```

Figure 16 (contd.)

```
40081 gttttcact attgacagct acatctttat ctatactaac tatcattttt cttagttcag
40141 ctacctcaac ttctaaatct ttgaaagttc ctctatctat ataattacct tcttgtatct
40201 tagacttaat agtttctact tgagaaacaa ggttgtttat ctccttatcc aactagaatc
40261 acctctaagg tctaaccgtt tcagattcag aatggatatc ataattttct aagaaatcat
40321 tgataatctc catataatta tccgtaacga cttttccgta agatgttttt gtatcaattt
40381 caaacctaag cttaccaaaa ctttggaggt ctaattcttt tattacaata ttagggtcat
40441 cagaaggaag gtaataatag tcgaagtata taattgagcc atttattaat actctgtcta
40501 ttctatagac gtggaaatag cgtctgtctc ttttaaaatg ggctagtgca tctttaaact
40561 ctaacttaag gatatcctta tatttagtca aagtggtaac ctccttacta ttaattttta
40621 aatttactta ttttgtggta taatagttat gataaaggca gttattataa ttatattaag
40681 aataatgata ataattattt ttctgagaa ataagccaa atactaaaaa cagataaagc
40741 atagatagct gatagatata ctatattaag agttaccta ctttatctt ttctatagat
40801 agaataacct aaagacgttg taacaccact aagtataaaa taatagaaac aaaaaagagg
40861 tatagacaga aaaaaagata cgataatcat tgttaaacac ctatttcttt ttgacctatt
40921 atttctagaa cttttagatt acaccactaa tataacatta aaagccagtc ataaaagtca
40981 attgttagat taataatata ataaaaaaag acaataggag gttaaagtgg ttgaataata
41041 acatagctat attcatattc aaaacactgg ttatcattat attcttacta ctaattttgt
41101 ctgttattaa ttccttgtcc cttatttact caataagacc gagtgtagtt atgacatact
41161 ttatctttgg tggtattgtt tctaatgtcg cacttactgt aacagataag ttcttactga
41221 agaaagaaga cccctacct gaatatgttc ttaaaaaagt agagataat gataaagaaa
41281 taagaataat caagaaaata atagaaagta attatggtat aacagcagaa gagataaaag
41341 ttagggctaa agcacaaaga agagtagagg aagatagtaa aaaggaagat tacaatgaaa
41401 acaaagaaag aaattaaaga acaaaggaaa gaacttaagg atggtgctac atctgtttct
41461 ttagtaaaaa agggagataa gagaatagct agccctagta gaatttgtag tctatgtggt
41521 cagcagttat caggtatgaa ttacactaaa ggaaaagcat tatcaaaagt taatcatttt
41581 catttacagt attctaagta tatttatttt gatatttgcg cagatatcaa caattgttat
41641 aaaaatttaa gaaaacgagg tgaaatggat tgagtgcaga aaatattaga gatataatta
41701 acaagaaaaa gttagaagaa gaggatacaa gaaaatatat agctgatggg tttatgaatg
41761 gtatcggtaa attaatgtac gaatttaata agaaagtaga taacaaagaa atagaagtta
41821 aagacccgaa tgatttatac aaattatttg tgatattctc tcaaatgcaa aatatggtca
41881 atgaaacttc tgaaggagga gcaatacctc aactatctag acctcaacag gaattatttg
41941 atgagattac aacagaagat agtaatggag aatctacagt tgatttacag aagatatcag
42001 aaatgtcagc ggaagatatt acagcaatga tttctgaaaa ggaaaaagta atgaatgagg
42061 aaaattcaga aacattctaa ggagaaagat ataaatggat ggaaaagaac taattaagat
42121 agcacaagaa acatttcaaa ctgaaaaaat aacaagagaa cagatagacc atataatcaa
42181 tatgctaaat cctctaccct atatgcttaa gtatcataca ctgagagggc atcctataac
42241 ttttagtatt cctaatagag atagaagtaa agcacaggct catagacctt ggcaaaactag
42301 gattgtaaat gatactcatc ctaataaggc tgtaataaaa tcacgtcagt taggtcttag
42361 tgaaatgggt gtaatggaaa tggttcattt tgcagatatg catagttatg ctaatgcaaa
42421 gtgtctgtat acattcccta caaacgaaca aatgaaaaaa tttgttcagt cacgttgaa
42481 ccctgtttta gagaaagaat attttagaga cattgttgat tgggataaag actcgttagg
42541 ttttaaaaag ataagaaact ctagtttatt cttagaaca agttctaaag caagtactgt
42601 agagggtgtg gatattgact atttatcttt agatgagtat gacagggtaa acttattagc
42661 agaatcgtct gcattagaat caatgtcttc atcaccttt aagattgtga gaagatggag
42721 cacaccttct gtacctggga tgggtataca caaattatac caacaatcag accagtggta
42781 ttacggtcat agatgtcaac attgtgatta cttaaatgaa atgagttata atgattacaa
42841 ccctgataat cttgaagaaa gtggaaatat gttatgtgtt aatcctgaag gtgtagatga
42901 gcaagctaaa acagtacaga atggcagtta ccaatttgtt tgtcaaaaat gtggtaaacc
42961 actagataga tggtataatg gtgagtggca ttgtaagtac cctgagcgta caaaaggtaa
43021 taaaggggta cgaggatacc taataacaca aatgaacgct gtatggatt ctgctgatga
43081 attaaaagag aaagaaatga atacagaatc taagcaagca ttctacaact atatttagg
43141 ttatcctttt gaagatgtta aacttagagt taatgaagaa gatgtttatg gtaacaaatc
43201 acctattgca gaaacacaat taatgaaacg atagatagat tctcatatag ctattggtat
43261 agattgggga aatactcact ggataactgt tcatggtatg ttacctaatg gtaaggtaga
43321 cttaatacga ttattctctg ttaaaaaaat gacaagacct gattttagtttg aagcagattt
43381 agaaaaaata atttgggaaa tatctaagta cgaccctgat attataattg cagataacgg
```

Figure 16 (contd.)

```
43441 ggactcaggt aataatgttt taaaactcat taatcatttt ggaaaagata aagtatttgg
43501 atgtacttat aaatcttctc ctaaatctac cggacaatta agacctgaat ttaatgagaa
43561 caataatagg gttacagtgg ataaattaat gcagaataaa agatatgtac aagcacttaa
43621 gacaaaggat ataagtgttt atagtacagt agatgatgat ttaaaaactt tcttaaaaca
43681 ttggcagaat gttgttatta tggatgaaga agatgaaaaa actggagaaa tgtaccaagt
43741 tatcaaacgt aaaggtgacg accactatgc acaagcaagt gtctacgcct atataggatt
43801 aacaagaata aaagaacttc ttaaagaagg aaacggtaca agctttggtt ctacatttgt
43861 ttctactgat tacaatcaag aaggaaataa acaattctac tttgatgaat agaggtgaaa
43921 tagacttgac agataaatta tttatggta caattagtaa tgaagaaatt aataaaagtg
43981 tattgaattt gttattgggt gaggaattat ccttagatta tgtttctaaa aatagtgata
44041 cttagatgt taaatatgaa catgtttata aatctctagg attcgataat ttctttgatt
44101 gtttttata tgctaataga gagcctgaaa tagtccataa aggtggagat aaaaatcttg
44161 gtggactaaa taaggttaaa cgtactgtta ttcgtaatgg taaagaaatg gaaatgacag
44221 tttacgaaga tggtaataaa gagaacgata gtaaagaaaa acaagaagga aaagaagaag
44281 ttagtagaag tgcagtagga gcaagggcta tttctaatgg tgaagaagga aaggtaaacc
44341 ctaaaaaggt agcaaattca ttatctaatt taagtaaaaa aggtgtagat gtatcacata
44401 ttaatacaaa ctcatcattg tataaagagt ttgttgatga taacggtgat acattaggaa
44461 ttacatcttt taaacgaact gaaaatgata taatattaga atcttatgca agttcacatg
44521 attcagatgg tgtaggagca agagctatta tggaattatt acgttaagt attaaggaaa
44581 ataaaaatgc agttgtgtat gatatagaat tacctgaagc agtagagtat ttaaaaactt
44641 taggatttaa acctaataaa gatggataca tcttaagaaa aaaagatgta aaacaattct
44701 taggtgatta tagtgatttt atttagcact atagtcatct attctattgt atttattcta
44761 tatattgtat taaaaacaat ttatataaag tctaatatga gtagaataga taacacaact
44821 gaattattaa aaatattaca ggaagatatt gaaggtaaga taaaaaagga aggaagaaat
44881 aaatgacttt agaagaaaat aaattaacat tagaagaatc aataactcca cttagcaaag
44941 aggagaaaga agatagtatt aaagaatta gcagtttatt atgtgaaatg gtaaatagac
45001 tatataagtc ttataatgta tttagacaag accctatgga tgaaactcaa cgtctagatg
45061 gctctttaat ggtcttcaa agtagattaa atgaccctt aacaggagat ttacatgata
45121 agatgtataa actgctttt tcaaaacgta ttgatatttt cgaagctaat aagcaattta
45181 gaaaagatgt agaagcaggt aaagcaattg agttaggtga tgtagctatt atagatacag
45241 cattaagtaa catccttca ggcaatgagt tccaaggaag tatttcattt atgcttagaa
45301 aagacttga agaaaaagaa cgaattagaa aagaagaaga agagaaactt aataacttat
45361 aaaagggaag aattatgaga ctatataaaa tgaggtatca taattgaaaa agaaaccaca
45421 aggcaatgag gtaatcataa ccataataac ggttatgata gcagtatttg tagtcattat
45481 gaccatattt tttaataaat atcaagatgc taaagaagat aaagatagat atcaaagatt
45541 agtagagatt tataaaaaag cagatgataa tgatggtgag actaaaaaga aatatgttaa
45601 aagattaaat aaggctgaag aagaacttaa aaaagtaaaa aaagaaacaa attataaaga
45661 ttataataag aagtcaagta agaaaagaca aaaagaagat aaagaaacta gagagaaaat
45721 atatgatgta actggtgatg atgacttaat attagtaaaa aataatattg agtttagtga
45781 taaagtagac aagcccgaaa tacttatttag tgaagatgga attggtacga taactgttcc
45841 tgtagatagt gggtatgaaa aacaaacagt aggttctatt attactagtg tattaggttc
45901 tccttccta tcacctggtt caaatagtat agatggttta agtgttatta acgataatgt
45961 ttatccaaat acagtagata gcatagtaga agatacaaaa cctctatta acttaccaac
46021 ggataatcct attataacaa atccagttga accaactata ccttcagata ttatacctcc
46081 tattgataat ccttcagttc cgatatctcc tgagaaccca ggagataata atcaaggaaa
46141 tacagataat ccaaatcctc cccctccagg gtacacagat gaagatggtg gaagaggctc
46201 cggtggtgga ggaaattctg aaccaccatc aacggaagaa ccttcggata tggtaacac
46261 cggaggagga gattgggaag aaaaacctga cccaggagaa gaaccttcag ataatggtaa
46321 tacaggagga aatggtggag aagttacgcc tgaacctgaa cctgaacctg aacctgaacc
46381 tgaacctgaa cctgaacctg aacctgaacc atctgaaccg tctgacaatc ctgatgaaaa
46441 tggaggatgg gaaactgaac caactgaacc tgagtcacct tcagagccgg acgataaagt
46501 ggacgaagaa gataaaaatg aagatactac agatgataaa cagcccactg aacaaccgga
46561 cgataacaac atagataatg aagataaaac tgaagaggag taattactcc tctttttgt
46621 ttgctatatt aaataagagc taaatataaa aaaattgaac attacggtgg tgaaaacttt
46681 gttaggaatg aatattataa cgtcactatc agtagtattt acttgtttaa gtcttttaac
46741 tttaatgatt tttgttcata gtaagttctc tagtaaaaac gtttttgttt tgtatgtaat
```

Figure 16 (contd.)

```
46801 ttatgctata ataggaatag gtacatacat agttttaact atgtttcaaa caacatctgt
46861 acttattaag aatgatgtaa tagattccat agaaaatact gaacattata ttggattcaa
46921 tgaccctata attatattta ctataagttt tataggtgca atacttggag gaatttggta
46981 caagtgatg aaaattatta aaagagtaa ctttaaagat aaaaaataaa aaagacggtg
47041 aataggttga tattctctaa agataaaaaa tgggatgaag caaaagattt catcaaaggt
47101 caaggtatgc aagataattg gatagagatt gtagattatt atagacagat aggtggaaaa
47161 cacgtagctg tttttattgc tttaaacaaa gtaaaataca tgattctaga agcaacaaaa
47221 gacaataagg taatattagt agataaagat aataatatac tattagaaga ttatgatatt
47281 gttatggaaa gtaagaagat gttttattac attgaagaac cgttcgaggt taaaataaat
47341 atccctcaac atattagaga tgtaacttat aataatactg ttgtattaac tacagtaaga
47401 gggagtagag gtgactagta attggcagat ttatttaagc aattcagatt aggtaaagac
47461 tatggtaata atagtaccat tgctcaagtt cctattgatg aaggattaca agctaacatt
47521 aaaaaaatag aacaagacaa taagagtat caagatttaa ctaagtcttt atacggacag
47581 caacaggctt atgcagagcc atttatagaa atgatggata cgaatcctga atttagagat
47641 aagagaagtt acatgaagaa cgaacataac ttacatgatg ttttgaaaaa gtttggtaat
47701 aaccctatcc ttaatgctat catacttaca cgttcaaatc aagtagctat gtattgtcaa
47761 cctgcaagat attcagagaa aggtttaggt ttgaggtaa gattaagaga cctagatgcg
47821 gaacccggta gaaaagaaaa agaagaaatg aaacgtatag aagattttat tgttaataca
47881 ggtaaagata aagatgtaga tagagattca tttcaaactt tctgtaagaa aattgttaga
47941 gatacttaca tctatgacca agttaacttt gaaaaagtat ttaataagaa taataaaact
48001 aaattagaaa aattcatagc agtagaccct tctactattt tttatgcaac agataaaaaa
48061 ggtaaaatta ttaaggtgg taagagattt gttcaagtag tagataaaag agtagtagct
48121 agttttactt ctagagagtt agctatgggt ataagaaacc ctagaactga attatcttct
48181 tcaggatatg gattatcaga agtagagata gctatgaaag agttattgc ctacaataac
48241 actgaatcat ttaatgatag attcttctcc cacggtggta ctactagagg tattttacag
48301 atacgttcag accaacaaca atcacaacat gcattagaga acttaagcg tgaatggaaa
48361 tctagttat caggtatcaa cggttcatgg caaataccag tggtaatggc agatgatatt
48421 aaattgtca atatgacacc aactgctaat gatatgcaat ttgagaaatg gttaaattac
48481 cttatcaata ttatatctgc tttatatggt attgaccctg cagaaattgg tttccctaat
48541 agaggaggag ctacaggttc taaaggtggt tctactttaa atgaggctga cccgggtaaa
48601 aaacaacaac aatctcaaaa taaaggttta caacctttac ttagattat tgaagactta
48661 gttaatagac atattatatc agaatatgga gataagtata cattccaatt cgtaggtgga
48721 gatactaaga gtgctactga taaacttaat attcttaaac tagagactca aatatttaaa
48781 acagttaatg aggctagaga agagcaaggt aagaaaccta ttgaaggtgg agacattatt
48841 ctagatgctt cattcttaca aggaacagcc caattacaac aagataaaca atataatgat
48901 ggtaaacaaa agaacgttt acaaatgatg atgagtttac tagaaggaga caatgatgat
48961 tctgaagaag ggcaatcaac agattctagt aatgatgata aagagatagg aacagatgca
49021 caaataaaag gtgacgataa tgtttatcgt actcaaacat ctaataaagg tcaaggaaga
49081 aaaggagaaa aatcttctga cttaaaacat taattaataa gcctagaata aatctaggct
49141 ttgtttattt tttcgtaat ttaatttga taaatgtaat aactatgata tactatatgt
49201 aattgatatt aatacataaa aaatattaat atttcactta caagttatta ttgttatatt
49261 attaacgtaa aagtaaataa aataacaagt ggaggtgtag acaccttggg aagaaataaa
49321 atttaatgct tttgtaccta tggatttgaa gaaatctgta tcaacagctt ctgatactaa
49381 tgagtattct atcgttcag gatgggctag tactccaagt atggatttac agaatgatat
49441 agttaatcct aaaggaatag atatagagta ttttaagtca caagggtaca ttaattatga
49501 gcatcaaagt gataaagttg taggtatacc tacagagaat tgctatgtgg atatagaaaa
49561 aggtttattt attgaagcaa agctatggaa gaatgacgaa aatgtgtta agatgcttga
49621 tttagctgag aaattagaaa aatcaggtag tggaagacgt ttaggttttt ctattgaagg
49681 tgcagttaaa aaacgtaata taatgacaa tcgagttatt gatgaagtta tgataaccgg
49741 agttgcatta gttaaaaacc ctgctaatcc tgaagcaaca tgggaaagct ttatgaaatc
49801 attttaact ggtcatggta catcacctga cactcaagtt gatgcaggag cttaagaaa
49861 agaagaaata gcatctagca ttacaaattt agcttacgtc ataagatta aagatttaaa
49921 agagtttaat gatgtatgga atggcgtgt tgaagatttg agtaaatcta atagtatggg
49981 atatgaggaa tcagtccta cgttacaact agctaaaggt ttatctcgta aagatgcaga
50041 actagcagta atggatataa acaaacaaaa actagaatag gtaaggagaa tacattctat
50101 gagtaaagaa atgcaaaata tttagaaga gtatgataag ttaaatgctc aagaggcagt
```

Figure 16 (contd.)

```
50161 ttcgaaatct gtagaagatg atgaaaagaa tacagtagaa tctaccgaag agcaagtagc
50221 agaaacaact gaagaacctg ctaaagaacc tgaaaaagta tctgaggaag atgctaaaga
50281 agcacaagag caaggtgaaa aagttgaatc tgaagaggta gcagaaggca atgaagatga
50341 ggaagttgaa aaatcagcta aagaatcaaa agaccctgta gaccaaaaag atactaagac
50401 agaaaataaa gacaacgaga aacgtaaaaa taaaaaagat aaaaaagaag attctgacga
50461 tgaagataaa gatactgacg atgataaaga taagaaagaa gataagaagg aaaaaacttc
50521 taaatcaatt tctgatgaag atatcacaac agtatttaaa tctatcttaa catcttttga
50581 aaacttaaat aaagagaaag aaaacttgc tactaaagaa gatttaagtg aagttagtaa
50641 atctattaat gagttatcag caaaaatttc tgaaatccaa gctgaagatg tttctaaatc
50701 agtagacact gatgaagaag ctgtagaaaa atcagtaaca tctacaaacg gagagcaaga
50761 aaaagtagaa ggttacgttt ctaaatcagt agacactgaa gaacaagctg aaactggtga
50821 agcaaaatca gaagaagctg aagaagtaca agaagataac acatttaaag gattaagtca
50881 agaagaacga actaagttca tggattctta caaagcacaa gctaaagacc ctagagcttc
50941 taaacatgac ttacaatcag cttaccaatc ttacttgaac attaacactg acctactaa
51001 tgcatcagag aaagatatta aaactgtaaa agactttgca caaatttaat taatgcacaa
51061 agttgtgtta tattatacgg tgtaactaaa gaatataaat agggtacatt ttactgtacc
51121 ctacataaaa taaaaagaac acaaatgaaa ggtgataaat ttatatgact atcgaaaaga
51181 acctgtcaga cgttcaacaa aagtacgctg accaattcca agaagacgta gtaaagtcat
51241 tccaaactgg ttatggaatc actcctgata cacaaattga cgcaggagct ttacgtagag
51301 aaatttaga tgaccaaatc acaatgttaa catggactaa tgaagactta atcttctatc
51361 gtgatatctc acgccgtcct gctcaatcta cagtagtaaa atacgaccaa tatttacgtc
51421 atggtaacgt aggtcactct cgtttcgtta aagaaatcgg agtagcacca gtatctgacc
51481 caaatatccg tcaaaaaact gtatcaatga aatacgtttc tgatactaaa aatatgtcaa
51541 ttgcatcagg tttagtaaat aacattgctg acccatcaca aatccttaca gaagatgcta
51601 tcgcagttgt tgcaaaaaca attgagtggg cttcattcta cggtgacgct tcattaactt
51661 ctgaagttga aggtgaaggt ctagagtttg atggtttagc taaattaatt gacaaaaata
51721 acgtaattaa cgctaaaggt aatcaattaa ctgagaaaca cttaaatgag gcggcggtac
51781 gtatcggtaa aggtttcggt acagctacag atgcttacat gcctatcggt gtacacgcag
51841 acttcgttaa ctcaatctta ggtcgtcaaa tgcaattaat gcaagacaac agcggtaacg
51901 ttaacactgg ttacagcgta aatggttcct actcatctcg tggattcatt aaattacatg
51961 gttctacagt aatggaaaat gaactaatct tagatgaaatc attacaacca ttaccaaatg
52021 ctccacaacc tgctaaagtt acagctactg ttgaaactaa gcaaaaaggt gcttttgaaa
52081 atgaagaaga ccgtgcagga ttatcatata aagtagtagt taactcagat gacgctcaat
52141 cagctccttc tgaagaagta acagctacag tatctaacgt agacgatggt gttaaacttt
52201 caattaatgt taacgctatg taccaacaac aaccacaatt cgtttctatc taccgtcaag
52261 gtaaagaaac aggtatgtac ttcctaatca aacgtgtacc agttaaagat gcacaagaag
52321 acggaacaat cgtattcgta gataagaacg aaacattgcc tgaaacagca gacgtatttg
52381 ttggtgaaat gtcaccacaa gtagttcact tattcgaatt acttccaatg atgaaattac
52441 cattagctca aattaatgct tctattacat ttgcagtatt atggtatggt gcattagcat
52501 tacgtgctcc taaaaaatgg gctcgtatta aaaacgttcg ttatatcgca gtttaataga
52561 ataagaaaaa ctgaatacaa gagaataggg ataaacttag ggtttatccc ttttttatta
52621 aaataaactt gaagggattt aataaatatg ttatactata agaaactatt agataaaaaa
52681 atggctactg tttatggtac agtggagatt gacaaagatg gagtagtcaa aggattaact
52741 aaagaacaag aaaagaatt tgccaatgtt ccaggttttg aatttgaaga agaaaagaaa
52801 actactagaa aacaatcagc ttctactagt aagaagaag agcctaagga agaggaaaag
52861 aaagcctcta ctagaaaaac tacaaatact actagaaaat ctacagcacg taaacaaca
52921 gccaaaaag atgaaaataa gtaaagggtg aattaaatgg ttaactcaat gtttggaggg
52981 gacttagacc cttatgaaaa atcattaaac tatgaatatc cttatcatcc tagtggtaat
53041 cctaaacaca tagatgtaag tgagatagat aatttaacat tagctgatta tggatggtca
53101 ccggatgcag ttaaagcata tatgttcggt attgtagttc aaaatcctga tacaggacag
53161 cctatggggtg acgagttcta taccatata ttggaaaagag cggtaggtaa agctgaaaga
53221 gcattagata tatctatact acctgacact caacatgaga tgagagatta tcatgagaca
53281 gagtttaata gttacatgtt tgtcatgct tacagaaaac ctatattaca ggtagagaac
53334 ttacagctac agtttaatgg tagacctata tataaatacc ctgctaactg gtgggaagta
53401 gagcatctag caggacatgt tcaattattc cctacagcac ttatgcaaac aggacaatca
53461 atgtcatacg atgcagtatt caatggatac cctcaattag caggtgtata cccaccatca
```

```
53521 ggagcaacat ttgcacctca aatgatacga ttagaatatg tatcaggtat gcttccacgt
53581 aaaaaagcag gaagaaataa accttgggaa atgcccctg agttagaaca gttagttata
53641 aaatatgcat tgaaagaaat ataccaagta tggggtaact taattattgg tgccggtatt
53701 gctaataaaa cattagaagt agacggtatt acagagacaa taggtactac tcaatcagct
53761 atgtatggtg gagctagtgc tcagatactt caaataaatg aagatataaa agaactatta
53821 gatggtttaa gagcttactt tggatataat atgataggat tataaggagg gttagaaaat
53881 ggaaaaaccg tatatgatag gagctaactc taaccctaat gttattaata agtcaacaac
53941 atatactact acaacacaag cagatgaaca agataaaacct aagtatacta ctagactaga
54001 gttttgatacg attgacatga ttaggtttat taatgaccga ggtataaaag tactatggga
54061 agaagcatat ttctgtcctt gtcttaatcc tgatacagga catcctagag tagattgccc
54121 tagatgtcat ggtaaaggta ttgcatatct acctcctaaa gagacgataa tggcaataca
54181 gtctcaagag aaaggaacta accagttaga tataggtata ttagatacag gtactgcaat
54241 aggtaccact caattagaaa agagaattc ctatagagac aggttactg ttcctgaggt
54301 attgatgccc caacaaatga tttattttgt gaataaagat agaattaaaa aaggtatacc
54361 tttatactac gatgtaaaag aaataacta tatagccact caagacggta cagtctatga
54421 agaagattat gaaatcaaga ataatagatt gtatttaaat gaaaaatatg agaatcatac
54481 agtaacttta aagatactta tgactttaag atatgtagta tcagatatac taaaagaaag
54541 tcgttatcaa tatactaagt ttaatcaacc taaatcaaaa tttgaaaact tacctcaaaa
54601 attacttctt aaaagggaag atgtcattgt actacaagac cctataaag ttaatgatgg
54661 tatagaagaa gacctagaaa ttcaagtaga tgaccctaag gcttcggcat ctaatcctag
54721 taatttaggt ggatcttcg gaggtgcatt taaataatgc cagttcatgg aaagagacct
54781 aatttattta aaaataaaaa ctataagcag gtaggtaaga gaacaattga tggtatgcgt
54841 tcagaagttc ttgataaatt acaagcaaca gcacagcaag tagagaaatac tagtattaaa
54901 cgtatgccta cttatctaca aataacagag aaaaagcttg aaaaagaagg agtagtagac
54961 cttaaaaaag cttttgctca ctcatctaaa aagaaaacta gtaaagatgg cggatggtat
55021 ttaactgtac caatccgcat caaaactagt agaatgaata acagtactta tcaagatatg
55081 agaactttaa aagtagaaata aggaacaggt tcagtttcga agataactga ttacctagaa
55141 ggacgtagga agaatgtaag ccaccctca atgaagcctg aacctatgac tcataatatg
55201 actaaagtta aaagaggaaa gcaatcttct tactttatat ttagaactgt ttctagtaag
55261 tcacctgcta gttcttggat acttaacaga gataaagtta atgaagataa cttctctaaa
55321 acaactctaa aaactgttaa gcaattaatg aactggaaga tgaaaaattt aaattaagag
55381 gagggttagt attaaatggc aataacatca gttgattcat atttattatc agaaataaag
55441 cctagactta acactgtgct agagaattgt tatattatag atgaagtttt aaaagacttt
55501 gattatcaaa ctagagagag cttaaagaa gctttctgtg gtaagaatgc acaacatgaa
55561 gtaacggtag gatttaactt cccaaaattt aaaaataact atgaagctca ttacttgata
55621 caattaggtc aaggacaaga gacaaaaaac tctttaggga gtattcagtc atcttacttt
55681 gaggcaacag gagatacttt agtcgaatct tctacagcaa taagagaaga tgataagtta
55741 gtttttactg tttctaaacc aataggagag ttaataaagg tagaagatat agagtttgct
55801 aaatacgata atcttcaggt tgaaggtaat aaggtatcat ttaagtatca aacaaatgaa
55861 gattatgaga actacaatgc taacattata tttaccgaaa agaaaaatga ttctaaaggt
55921 ttagtaaaag gattcacagt tgaagaacaa gtaacagttg taggtctttc attaatgta
55981 gacgttgcaa gatgtttgga tgctgtactg aaaatgattt taatatctat gagagatagt
56041 atagaagagc aacaaacatt ccaattcag aatttgtctt ttggtgatat tgcaccaata
56101 atagaagatg gtgactcaat gattttggt agaccaacaa ttattaagta cacaagttct
56161 ctagatttgg attatactat tacacaagat attaataaac taacttttaa agaaagaaag
56221 gattggaagt aggatggcta gaaaaaagac acctgaaaat aacactccta aatttaatgg
56281 ttatgttcat atagatacat tccttgatac tgcaaaaacc cttttaata tgagggattc
56341 acaagtagca ggatttaaag cttatatgga aggtagtcat tatttgttta gtgagcaaga
56401 attcttacca tcattagaga agtatctagg taggaaatta gatatataat aacattcaga
56461 taaggagaat taaatatggc agtagaacca ttcccaagaa gacctattac ccgtcctcat
56521 gcatctattg aagtagatac ttcaggtayc ggtggctcag caggttcaag tgaaaaagta
56581 ttttgcttaa tcggtcaggc tgaaggcgga gaaccaaata cagtttatga attacgtaac
56641 tatkcacaag ctaaacgttt attccgttca ggagaattac ttgatgcaat agaattagca
56701 tggggttcta accctaacta tacagcagga cgtatttag ctatgcgtat agaagatgct
56761 aaacctgctt cagcggaaat tggcggatta aaataacat ctaaatcta cggtaatgtt
56821 gctaacaaca ttcaagtagg attagaaaag aatacactaa gtgattcatt acgtttaaga
```

```
56881 gtaatattcc aagatgaccg tttcaatgag gtttatgata atatcggtaa tatcttcaca
56941 atcaagtaca aaggagaaga agctaacgca actttctctg tagaacatga tgaagaaact
57001 caaaaagcaa gtcgtttagt attaaaagtt ggagaccaag aagttaagtc atatgattta
57061 actggtggag cttatgacta cactaatgct attattacag acattaatca attacctgat
57121 ttcgaagcta aattatcacc ttcggagat aagaacttag aatctagcaa attagataaa
57181 attgaaaatg caaatataaa agataaagct gtatatgtaa aagcagtttt tggtgactta
57241 gaaaaacaaa cagcttacaa tggtatcgta tctttcgagc aacttaatgc agaaggagaa
57301 gtaccaagta atgtagaggt tgaagcagga gaagaatcag ctacagtaac tgctacttca
57361 cctattaaaa ctattgaacc gtttgagtta actaagttaa aaggcggtac taatggtgaa
57421 ccacctgcta catgggcaga caagttagat aaatttgcac atgaaggcgg atactacatt
57481 gttccattat catctaaaca atcagttcat gcagaggtag cttcttttgt taaagaacgt
57541 tctgatgcag gagaaccaat gagagctatt gttggtggag gattcaatga atctaaagaa
57601 caattgttcg ttagacaagc atcattatct aatccacgag tatcattagt agctaactca
57661 ggtactttg ttatggatga tggacgtaaa aaccacgtac ctgcttacat ggtagccgta
57721 gctctaggtg gtcttgcaag tggtttagaa atcggtgaat caatcacatt caaaccacta
57781 cgtgtaagtt cattagacca aatctatgag tcaatagact tagatgaatt aaatgaaaat
57841 ggtattatta gtatagagtt tgttcgtaac cgtactaata cattcttcag aatcgttgac
57901 gatgtaacta cattcaacga taaatcagac ccagttaagg ctgaaatggc tgttggggaa
57961 gctaatgact tcttagtaag tgagcttaaa gttcaacttg aagaccggtt tattggtact
58021 cgtactatta atacaagtgc ttcaatcatt aaagacttta tccaatctta cttggggtcgt
58081 aagaaacgtg ataatgaaat tcaagacttc cctgctgaag acgtacaagt tattgttgaa
58141 ggtaacgaag caagaatttc aatgacagtt tacccaatca gaatcttcaa gaaaatctct
58201 gttagcttgg tttacaagca acagacatta caagcctagt ctaggtgacg gagtacctgg
58261 attaggtact cctattaata taatttgaat acttaggag agtgaataca gatggcatca
58321 gaagctaaac aaaccgtcca tactggtaat accgtcctac ttatgattaa aggtaaaccg
58381 gtaggaagag cacaatcagc atcaggtcaa cgtgaatacg gtacaactgg tgtatacgaa
58441 atcggttcta tcatgcctca agaacacgta tacttacgtt atgaaggtac aattcagta
58501 gaacgtttac gtatgaaaaa agaaaactt gcagatttag gatatgcttc acttggtgaa
58561 gaaattctta agaaagacat cattgatatt ttagtagtag ataacttaac aaaacaagtt
58621 attatttcat atcatggttg tagtgctaat aactacaacg agacataact tttttctgct
58681 gtgtctctgt acagtgatgt ataacaaaaa aacccttcta attcatggga accttaaca
58741 gataatgctg aaggcaatca tgagccaagc ctagtaaagt actaggaagg tgcaacgact
58801 agagaaaaga tagtttactg ttataggcag taaatgaaaa ctgagtatcg tacatctaag
58861 tagatggaaa tggagggatt cctaaagtaa cgtttaggaa tgtgatatag tctagtctat
58921 atggaaacat atagaaggta agaagtaacg actcttatcg taataataac aggcagacca
58981 atgaaatcgt aactgaagaa attgagtaga agaatgctcc tttaactaga aatagttata
59041 gcaaatccct ttaattcatg ggaaccctta acagataatg ctgaaggcaa tcatgagcca
59101 agcctagtaa agtactagga aggtgcaacg actagtcaga atgacgtaca tctaagcaga
59161 tggaaatagg ggacaccttc aatattaagg tgaagatata gtctgaacta tatagaaata
59221 tatagaaggt tcaagagtag cgttttgaat cgtaacaaat ttgtttctta tttaacagct
59281 agtgataaag cccgtaccta aagggtttaa agacctaaca ataaaagtta ggtcttttt
59341 attgacatat aactaacgat atggtaacat taaaatataa tattaaagag gtgttaagaa
59401 tggataaaaa aataatagga ttaaatacaa aaacattaga agagaaggtt tttactacta
59461 taaaagaagc agaaaaagaa attgaattaa gaggtaccgt taaaagatgt ttaaataatg
59521 aaattaagtc tactaaagga tggttatta ggtatgaaaa tgaagatttt cctgagaagg
59581 caagaacaat aacagacaaa agaattaagg ttgttgtttt aagtaaagaa caggaacaaa
59641 taaagttacc tcttgagatg gctaaaaatt tatatggaat acctaaacct atgattattg
59701 aagctattca atataaaagg aaaattaatg gctactctgt tagaagagct acaaaagaag
59761 agcaaaagat tacattatct aacattagtt atatagacta tataaaaaca gttaataacc
59821 caaacaatat taaaattatt aaaaataagg gttcttttgg tgaacagtta gttaagacaa
59881 tattagacta taataatata gaatataaaa gggaatattc tttaagaat gaattaggga
59941 caatacaaag aatggatttt ttagcagtag tagataataa aaaatactgt attgaatata
60001 tgggtgagca acattatgta gagaaaggta ataagtgggg ctcgttagaa aagagacaat
60061 ttctagattc tataaagaaa aaatactgtt acgaaaatgg gatatactat attgatatca
60121 gttataaaaa cagtgattta gagagtgtat tcaatgttat taataaacac ataccaggta
60181 ttaaaaaacc aaataaatct attattgata ttggtgtgac aataaatata gaagaaatgt
```

Figure 16 (contd.)

```
60241 tagaatacta taaggagcat actaaaaaag aaacagctta taaatatgga gtaaaggaac
60301 ataatattga taacttatta gtaaatttaa actatgaaag caaaagaaaa cctaaagata
60361 taatacaagt atataagaga gatgaaaaaa tatttgaggg cacttataat gaaattaagg
60421 atgaatttaa ttttactatg agtaatgttt tgaaatgttt aaatggagaa ctagataaaa
60481 catcacaaca ttactttaaa tataaagatt cagaaaaaga tagagttaga caactaaaga
60541 ctaaagaaag acataataaa agaggaacag taagaggaag tagtaacaag gatgtcgttc
60601 tcaaggacat atattcagga gaggaaactg tatattcttc tattaaggag tgtcacgaaa
60661 taacaggtct aaacaaagac aaattataca agttatttaa tccaaataaa agtaaacaaa
60721 ttatagacaa atatataggt aaaagctatg gcggtgaata ccctataact gtagaagagg
60781 ctctaaatat aattaaccct tgaccagtat caagggttat gttattataa taaataagaa
60841 gggattatat tgacaaacaa aagaaaaaca ataggtaaaa taagtaactc aagagcaaca
60901 tggaatatta atccggtaac taaagttaaa aaagataaaa caaaatattc tagaaaaaat
60961 aaacataaag gtcttgacaa ttataattaa ctaaggtata ttattagtat aacaaaaaaa
61021 ggagatgggt atatgagtac attttggtca gaaagaagaa caactaataa agataggcaa
61081 gttaaaaaac attatactca aatgagtatg tatgaaagaa agaaatgtgt agagttatta
61141 caagagacaa ttactgaaaa tagaattatt aatttacac gacatagtgc aaaaaaggtt
61201 aaaggtaaac caacaacaaa tatacctaaa ttaataggtt ttatttttaa aaataagttt
61261 gcctacgaaa atatcataga gtacaataac acagattata atggtaaatat tgagaggaga
61321 attgttgtta aacatcctaa agttataact gtagaaggaa aacctagcta tcagtttttg
61381 acaattagtc ttgaagatgc tagagttatt acggtgtggt ataacagtgt agatgataca
61441 catagaacac tagatttaaa ttattatagt aaagacttga caattcaata aggaggtatt
61501 ataatgggta taacaatagt aaatagttat tttattctgt ctagcatttt cctcatcata
61561 ttaaccatat taaatggtaa gggtacagtt acaagggaat cattaactat gagtaaaata
61621 ttagtagtaa taacatcaat tcaattttta gcatgtttaa ttattaatgg tatttattgg
61681 tcactaaaat ttatgtagta gaactagaat aaaagtattg acaaattaaa actaataaat
61741 tataataaag gtataacaaa ttaaaggaga agatataaaa tgtcacaaga taaattaaga
61801 gcaatttaca cagaaatgaa agtagaatta cacaaaattc ctaaagaggt agatataaca
61861 agtaaatcaa ctgcaattgc aatcaatcag attttagata aattcaaaac attaacagaa
61921 caagcaggaa agattactag aaaatatttta gaaggtcaag aaatattaac tattgattat
61981 gagttattatg attcattaca agaatactat atttacctac ttagaaatag tgaaaagatt
62041 gaacaaagtt tacaagaaat tactaagcgt acaggtgaat atgtaaagta attttgattt
62101 aaaaacaaaa tatgatatac tatgtttaaa gtagtaagcc tacactagtc cgtgttatat
62161 taatattgaa tcggataagc gtaggctta ttaatattta aaaaaggaag gtatatcata
62221 ttatggcaga agaaattaaa aaggaacaag atgtacaaga aacaactaaa gaagaaaaaa
62281 aagatgttag taaaatgaca ccggaagaaa tagataaatt aaaatatcaa gacaaacaag
62341 aaaaagaaca agttattaac aaagttatta aaggcgttaa tgatacttgg gaaaaagaat
62401 ataactttga agaactagac ttaagattta aagttaagat taaattacct aatgcacgag
62461 aacaaggtaa tatctttgcg ttacgttctg cttacttagg tggtatggat atgtaccaaa
62521 cagaccaagt gattagagca tatcaaatgt tagctaccttt acaggaagta ggtattgaag
62581 ttcctaagga attccaagac cctgacgata tttataactt atatccttta actgttatgt
62641 atgaagattg gttaggattc ttaaactcct ttcgttacta atagtataga aacattagat
62701 aaagatatag aacgatgggg cggtatggaa tcaattgtta aacaacctt atctagaaat
62761 ctatgggcta ttatgaaaga gtttaatgtt ttacctaccg agcaaagatt taaggactta
62821 gacgattatc agatagagtt tattattggg aatatgaaca gagatgttta tgaacataac
62881 aaacaactta aacaagctca aaaaggtgga aaattcgata gtcaattcga agatgatgat
62941 agtagttggt ggaatgaatc tcatgaagac tttgacccag tacctgattt cttagatgct
63001 gatgatttag cacaacaggt ggaagctaaa ttatccgata gagataagga agaaagagct
63061 aagagaaacg atgcggagtt aaatgatgaa acagaaggac ttactacaca acatctagct
63121 atgatggaat acatcagaca gaaacaacaa gaattagatg atgaagtagg aaatggtaag
63181 actagtgaag aggatgctac tatatcacaa gatagcgtta ataaagcact agaagaccta
63241 gatgatgact ggtatatgta aagggtggta ggtgatacta ccatcctat ttttttaaaa
63301 tggatggtga ataatgatgg caatgaatga tgattataga ttggtcttgt ccggtgatag
63361 ttcggattta gagaatagtc tgaaggcaat agaactttat atggattctt tagagtctaa
63421 gaatattgat gctcctttag ataatttctt aaaaaaaatta aaagtaattg ctaaagaagt
63481 taaaaatgta cagaacgcaa tggataaaca agatggtaaa tctgttatat cttctaaaga
63541 catggatgaa tctattaaat ccactcaatc tgctacaaag aatataaatg aattaaagaa
```

```
63601 agctttagat gaccttcaaa aagagaatat atctaaaggt attgcacctg accctgaagt
63661 tgaaaaagca tatgctaaga tgggtaaagt tgtagatgaa actcaagaaa aacttgagaa
63721 aatgtcttca caaaaaatag gttctgatgc tagtattcaa aatagaatta aggaaatgaa
63781 aaccttaaat caagtaactg aagaatacaa taaaataagt aaagattcta gcgcaactaa
63841 agattataca aaacgattaa gagctaatcg taatatgact agaggttaca tggagcgttc
63901 agaaggaaca ggacgattaa catatgacca aggtgcacga gttagaagtg agctaggtaa
63961 aataagttct tatgagagcc aaagaaaaca aaaccaacgt aatttaggac aagcaagaga
64021 gcaatatagc aactatagaa atcaacaaca agacttgact aaacgtagag ctagcggtca
64081 aattaataag gaacaatatg aacaagagtt agctctatt aaacaggaaa tgaaagctag
64141 agaagaactt atatctaact atgagaaatt aggagcagaa cttgataaaa cagttcagta
64201 ttataagggt tcagttcaaa aggatttcca atctagagat gtagaccaac aacgaggaac
64261 atttggtaga atggttcaag aacgtttgcc atctattggt tctcatgcta tgatgggtac
64321 tacagctatg gctacaggtt tatacatgaa gggtgcctca ctaagtgaaa ctaatagacc
64381 tatggttaca tcattaggtc aaaattccga taatatggaa atagattctg taagaaatgc
64441 atatggagac ttgtcaattg ataacaaatt aggttataat agtactgaca tgttgaaaat
64501 ggctacttca tatgaagcat cagtaggaca taaaagtgat gaggacacaa tggcaggaac
64561 taaacagctt gctattggag gacgttcttt aggcattaaa gaccaagaag cttatcaaga
64621 gtctatgggt caaatcatgc ataccggtgg agtaaattct gataacatga aggaaatgca
64681 agatgcattc ttaggtggta ttaaacaatc aggcatggtt ggtcgtcaag atgaacaact
64741 taaagcacta ggttctatag cggaacaatc aggagaagga agaactctaa ctaaagacca
64801 aatgagtaac cttactgcca tgcaatctac ttttgcagag tcaggaagta aaggattaca
64861 aggtgaacaa ggtgccaatg ctattaacag tatagaccaa ggactaaaaa atggtatgaa
64921 tagttcttat gctcgtatag caatgggatg gggaacgcaa taccaaggtc ttgaaggtgg
64981 atatgattta caaaaacgta tggatgaagg tatatctaat cctgaaaact tgacagatat
65041 ggctgatata gctactcaaa tgggtggcag tgaaaaagaa caaaaatacc tatttaatag
65101 aagtatgaaa gaaataggcg ctaacctaac tatggagcaa tctgatgaaa tatttaagga
65161 tgctcaatcc ggaaaactgt ctaaagaaga gttagctaag aaagctaaga aatggaaaa
65221 agaaggtaaa aaagaaggag aagataacgc cactgattat aaagaatcta atcaggaaa
65281 aaatgaccaa aataaatcta agactgatga taaagcagaa gatacttatg atatggctca
65341 accactaaga gatgctcata gtgctttagc aggtcttcct gcccctatat atttagctat
65401 tggtgctata ggagcattta cagcttcact aattgcatct gcaagtcaat ttggagcagg
65461 tcacttaatt ggtaaaggag ccaaaggact tagaaataaa tttggtagaa ataaaggcgg
65521 tagctccggt ggtaaaccta tggcaggtgg aatgcctagt ggtggtggtt cacctaaggg
65581 tggaggctca cctaaaggtg ggggcactcg ttctactgga ggaaaaaatac ttgatagcgc
65641 taaaggtctt ggaggattcc tagtaggtgg cgcaggatgg aaaggtatgt ttggcgggga
65701 gtctaaaggt aaaggcttta aacaaacatc taagaagcc tggtcaggta ctagaaaagt
65761 atttaataga gataatggta gaaaagccat ggataaatct aaagatatag ctaaaggtac
65821 cggtagtggt cttaaagata tctataatga tagtatattt ggtaaagaaa gaagacaaaa
65881 cctaggagaa aaagctaaag gttttggtgg caaagctaag ggtctctatg gtaagtttgc
65941 tgataagttt ggtgacggag gtaaaaatgg tattctttca caatcaccaa aagcaggtgg
66001 aagtggcata gggaaacttg gaaaacttgc aggtggactt ggaaaaggag ccggagtttt
66061 aggtgttgct acgtctgcct tatcattaat acctgcttta gcttccggag atagtaaagc
66121 tatcggcgga ggaataggct ctatgggtgg aggaatggca ggtgcatcag caggagcttc
66181 tataggagct ttatttggtg gtgtaggtgc aatacctgga gctttaatag gtgagcatat
66241 aggttccttc ggaggaggag ctgttggtga aaaagtcgga gacatggcta aaaaagctaa
66301 cactaaagaa ggatggaacc taggatggac taacggagat aaggatggta agaataaaat
66361 ccaagattct ttattaggaa aacctatatc taaagcatgg agcggtataa caggtctctt
66421 tgataatgac gctgaagcat ccgaagaaga tagtaaagat aagaaaaaag gtgttaaagg
66481 cgttaaagga gatactaaga agaaagaaaa aatgacagca gaacaactta gagaaaagaa
66541 taaccaatct gaaactaaga atcttaaaat ctatagtgat ttacttgaca gagctcagaa
66601 aattattgag agtgctaaag gtattaatat agatggagga acttctgata gtggttctga
66661 tagtggaggc tctgcatctg atgtaggtgg agaaggcgca gagaagatgt acaagttcct
66721 taaaggaaaa ggactatctg ataatcaggt aggagctgtt atgggaact tacaacaaga
66781 atctaatctt gaccctaatg ctaagaatgc ttctagtgga gcatttggta ttgctcagtg
66841 gttagggggct agaaaaacag gattagaaaa ttttgctaaa tctaaaggta aaaaatctag
66901 tgacatggat gttcaattag attacctatg gaaagaaatg cagtctgatt atgaaagcaa
```

Figure 16 (contd.)

```
66961 taatcttaaa aatgcaggtt ggagcaaagg tggaagctta gagcagaata caaaagcatt
67021 tgctactgga tttgaacgta tgggagcaaa cgaggctatg atgggtactc gtgttaacaa
67081 tgctaaggaa ttcaagaaga aatacggagg ctccggtggc ggaggtggtg gaggagccct
67141 atcctctact taccaagaag ctatgagtaa tcctgtatta actactggtt ctaattatag
67201 gggctctaat gatgcttcta atgcttctac aactaacaga ataaccgtca atgttaatgt
67261 tcaaggtgga aataatcctg aagaaactgg agacattatc ggaggaagaa ttagagaagt
67321 tctagatagt aacatggata tctttgcaaa tgaacataag agaagttatt agtaattttg
67381 tattgacaca agagtagtat catagtatac tactcttata catataaaaa ataaaaggaa
67441 gtatgtgtat atgcgtagaa taagaagacc taaggtaaga atagaaatag ttacagatga
67501 taatacattt acattgagat ttgaagatac acgagactat aatggtgatg agtttggagc
67561 taaacttta ggattccaaa ctaaaaactc tatggaagat gatagttcag ttttccaaat
67621 aaatatggca ggagatactt attgggataa gctagttatg gctaatgata tcataagaat
67681 atttattaca cctaatgatg accctaacga taaagaagga aaacaagaac gacttatcca
67741 ggtaggtatg gtttctcaag tatcaaaagt aggtagttac ggtaatgacc aaactcaatt
67801 tagaataaca ggtcaatctt ttgtaaaacc ttttatgaaa tttggattag gcgttattca
67861 ggaagttcaa gctgtattac ctgaagtagg ttggcttatt gatggtgatg gagataatga
67921 agtaaaattt actggtagct cagctcatga agtaatgact ggtattatac gtagatttat
67981 accttatatg aaatataact atactgaaaa aacatataat acaattgata actatcttga
68041 ttatgatgat ttaagtagtt gggatgagtt tgaaaaactt acagaagttt cagccttac
68101 taattttgat gggtcattaa aacagttaat ggatatggta acagctagac cttaatga
68161 gttattcttc aaaaattcag aaaaaacacc tggaaaggct caacttgtat taagaaagac
68221 ccctttaat cctactgagt ggagagcttt agatatgatt aaagtaccta ctgaggattt
68281 tatagaagag gatgtaggta aaagtgatgt agagacatat tctatattta cagcaacacc
68341 tgcaggtatg ttgaaagagc ttaacggtga tgtattttct aaaccacaat tccaccctga
68401 attaactgat agatatggtt atactaaatt tgaagtagaa aatatttatc ttagtacaaa
68461 atcaggttca gctactgagg attcagattc ttcaggtgat gataatggca cagaacgagg
68521 aacttattct aaaaattatga aagatttaag taactatgga agagataata tatctaaagg
68581 tatagataag tatacaagta aattatcttc aaaatataaa aacttaaaaa aagcccaagc
68641 taaaaaaatt atagagaagt ttgttaaaga aggaaaagta acagaaaaag aatatgaaaa
68701 aataacaggt aataaggtag atgatgaatt aacatcagat aacagaccga agttgacaaa
68761 agataaatta aagagtatac taaagagaa gtttaaaaca caagatgatt ttaataattc
68821 taagaaaaag aaaaaagcta agacagatgc acttaagaa ttgacaacta aatatcgttt
68881 tggtaataaa acacatgcta caactttatt agatgaatat attaaatata aaggagagcc
68941 acctaacgat gaggcttttg ataaatatct taaagctatt gaaggtgtta gtaatgtagc
69001 tacagacaca ggttcagatg caagtgatag ccctttagtt atgttttcta gaatgctatt
69061 taattggtat catggtaacc ctaacttcta tgcaggagat attattgttt taggagaccc
69121 taagtatgac ctaggtaaaa gattattat tgaagataag caacgaggag acacttggga
69181 gttctatatt gaatctgtag aacataaatt cgattataaa caggggtatt atacaactgt
69241 aggagtaact agaggtttaa aagacgctat tctagaagat ggtaaaggta gtccgcatag
69301 atttgcagga ttatggaatc aatcatcaga cttcatggga ggtcttatgg gtgaagatac
69361 ttctaaagaa cttaaagaaa aaggtgtagc agagaaacaa agtagtgggg ataaagatgg
69421 tggttctgat agtggtggag ctcaagatgg tggctcttta gattcactta aaaaatataa
69481 cggcaaactt cctaagcatg acccaagttt tgttcaacct ggtaaccgac attataagta
69541 tcagtgtaca tggtatgctt ataatagaag aggtcaatta ggcatacctg tgccttatg
69601 gggggacgcc gccgactgga taggtggtgc taaggagca ggttatggtg taggtagaac
69661 acctaaacaa ggtgcttgtg ttatatggca aagaggagtt caaggaggta gcccacaata
69721 tggtcacgta gcgtttgtag agaaagtatt agatggaggt aaaaaaatat ttatctctga
69781 acataactat gctaccccta atggatatgg tactagaacg ataagatatga gttcagccat
69841 aggtaagaat gcacaattca tttacgataa gaaataaagg aggatagtct atggcaacag
69901 ataagaagc taaagatgtt attgataaat ttatagacaa tgtatttaat tttgatgtac
69961 ttacaaaaga aagaataaaa gaaaaagatg aagaaattaa aaaataact acagatgata
70021 tgtatgaaaa ggttgtgtat atacgaccti atgttggagt aatacaaagc cttaacccctc
70081 agcatgttca gtatgaatca ttttctaata atggttatga tatagaggca gaattaagtt
70141 tcaggaaagt aagttattta gttgataaag ggtctatacc tacagattct ttatctactt
70201 taacagttca tttagtagaa cgaaatcaag aactattaat agattacttt gatgagatac
70261 aagatgtgtt gtatggagaa tatatggaag aagaatatgt atttgataaa gatgtaccat
```

Figure 16 (contd.)

```
70321 taagtacgat actagcatta gacttaaatg ataatcttaa atccttatca aatataaagt
70381 atatgttcaa aggtgctcct aaagagaatc catttggaac agataaagat gtttatatag
70441 atacttataa cttattatac tggttatatt taggtgaaga tgaagagtta gcatatccta
70501 tgaatattaa ctacttcttt acagagggaa gattcttac tatattcggt aaaggacata
70561 agtataaggt agatgttagt aaatttatag ttggagatat attattcttt ggtagaagtg
70621 atactaatat aggtatttat gtaggagatg gggagtttat atctatgatg ggtaaattcc
70681 ctaaagatga aacacctata ggaaaatata aacttgatga ttactggaat gaatttaacg
70741 gaagagttat gagattcgat gaagaggtgt atatttaatg gtagtaagat tccaatcttc
70801 catggggaga agtttaaaaa gagtagatic ggatgattta aatgtaaaag gattagtttt
70861 agctacagtt agtaaaatta attataaata tcaatcagta gaagttaaag ttaacaattt
70921 aactctagga agccgtatag gtgatgatgg tagcttagct gtaccttatc ctaaatcttt
70981 cataggaaga acacctgaag gaagcgtatt cggtacaaaa cctcttatta ctgaaggttc
71041 tgtagtatta atagggtttc taaatgatga tataaatagt cctattattt taagtgttta
71101 tggtgataat gaacaaaata aaatgattaa taccaatcct ctagatggag gtaagtttga
71161 tacagaaagt gtttataaat atagtagttc actatatgaa attttaccat ctttaaaatta
71221 taaatatgat gatggagaag gaacaagtat taggacttat aatggtaaat cattttctc
71281 tatgacatca ggtgaagaag agaaacctca ggcaacagat ttttatactg gaactgagta
71341 tcaagattta tttacttctt attatggtaa taagacatta attgagccta gaatacaaaa
71401 ggctcctaat atgttattta aacatcaagg agtttttat gatgatggca cgccggataa
71461 tcatataact actttatta tatctgaaag aggggatata agagcctcag ttttaaatac
71521 agaaacacag aaaagaacta cacaggaaat gtcaagtgat gggtcttata gagttatcaa
71581 acaagatgac gatttaatgt tggatgaagc tcaagtttgg attgagtatg gtattagtga
71641 agataataaa ttttatatta aaaatgacaa gcataaattt gaatttactg atgagggaat
71701 ctatatagat gataaaccta tgttagaaaa cttagatgag agtatagcag aggctatgaa
71761 gaatttgaat gaaatacaaa aagaactcga tgatataaac taccttctca agggtgtagg
71821 taaagacaat ttagaagaat taatagagtc tacaaaagag tctatagaag cttctaaaaa
71881 agcaacttca gatgtcaata gacttacaac tcagatagca gaagtgagtg gtagaactga
71941 aggtattata acacagttcc aaaaatttag agatgagact tttaaagatt tttatgaaga
72001 tgcttctact gttattaatg aagtaaatca gaattccct actatgaaaa cagatgttaa
72061 gaccttaaag actaaagttg ataacctaga gaaaactgaa ataccaaata ttaaaactag
72121 attaacagaa ctagaaaca ataataacaa tgctgataaa ataatctcag atagaggaga
72181 acataggt gctatgatac agttagagga aaatgtcaca gtacctatga gaaaatatat
72241 gccaatacca tggagcaaag ttacttataa taatgcagag ttttgggatt ctaataatcc
72301 tactcgatta gtagtaccta aaggaataac aaaagtaaga gttgcaggta atgttttgtg
72361 ggactctaac gccacaggac aacgtatgtt gagaatattg aaaaatggta cttatagtat
72421 aggattacct tatacaagag atgtagctat atctacagca cctcagaatg gtactagtgg
72481 agttattcct gttaaagaag gagattactt tgagtttgaa gcttccaag actcagaagg
72541 tgacagacaa ttcagagcag acccttatac atggtttagt atgaagcta tagaattaga
72601 aactgaaact atgggagaaag actttatgct tataggacat agaggagcaa ccggatacac
72661 agatgagcac acgataaaag gatatcaaat ggctttagat aaaggtgcag attatataga
72721 attggattta caattaacaa aagataataa gttattgtgt atgcatgatt ctactataga
72781 cagaacaaca acaggaacag gtaaggtagg agatatgacc ttatcttata tacaaactaa
72841 ctttacatct ctcaatggtg agccgatacc atctcttgat gatgtactaa atcattttgg
72901 aacaaaagtt aaatattata tagaaactaa acgtccgttt gatgctaata tggatagaga
72961 attattaact caattaaaag caaaaggatt aataggaata ggttcagaga gattccaagt
73021 aattattcaa tcatttgcta gagaatcttt aattaatatt cataatcaat tctctaatat
73081 accttttagct tacctaacaa gtacatttc tgaaagtgaa atggatgatt gtttaagtta
73141 tggtttttat gctattgcgc ctaaatatac aactataact aaagaattag tagatttagc
73201 tcatagtaaa gggcttaaag tccatgcatg gacggtaaac acaaaagaag aaatgcaaag
73261 cttaatacaa atgggtgtag atgattctt tacaaactac ctagatgaat ataaaagat
73321 ttaatattaa agacctatta atttaggtct tttttagtt gtaatttaaa ctagttcgtg
73381 atatattagt agtatgagat ttatatacat actgaaaagg agaggataaa atgccacaat
73441 cagatggaat aagtaatctt catagaatag ctttacgctt ccctaaagaa ggcggtggtt
73501 atgatatgta tagatttaaa gttaaccctg agaactacac aatagattca ccacaacgta
73561 cgacagcaat taaaacaaaa tcagatattg taatagaaga ttatggtaaa gacatagaag
73621 ttattaactt cacaggtaca actggtttta gacctgttag agaagcagat ggattaaaaa
```

```
73681 caggtaagca gaaaatggaa gagttacaaa gtagagttag tgaatatgct atgcaaggtg
73741 gcagtggtaa tgtaagtggt tcttacttac aatttttaa ctttacagat gatagttatt
73801 ataaagttca tttagctcct cagggggttaa agataactag gtctaaagat gaaccattac
73861 tttttagata tgaaataaca ttagtagtta ttggttcatt aacagaagca gatagaagtg
73921 ctgtaacaac agaagagttt ggtaacgtta aacctaatgc ttctcaaaga gtagatgagg
73981 gtataaaaga attagataaa aatgctcgta aaacgagaga tagaaacaat caagaaatat
74041 ctagaagaga aaatacaata cctaaatcta caggagataa tacgaacgag ggtaatagac
74101 ttaagcaaag cttccctagt agttctatat ataatcctag acaatctact aacggattaa
74161 aaggtaatat tgacaatatg gcgctgataa taggttacgg tgatggaggt gtatctagct
74221 aatgaataat tttataccac aacctcaagg tctacttaga tttttaaata ccctagatac
74281 agatttaact tcttctcata tgaatttact ggatgaagag gtatcatttg tatctaaatt
74341 ttatacacca cagctacaat taagtgaatt agcaaaaaaa gtattgacaa atataaagac
74401 agatgatata cctgtattag aaagagaatt taatgataat acaattatcc ataaagctaa
74461 cgatacatta ctaaaagtac aggctccaag aatgtatatg attctacagt cgattgtact
74521 tgaagcatat gctattgtta attgctttgt agaaaatccg agctctttaa aatacttaac
74581 tgaagaagat gttagtataa cacgggaaaa tttaaattat gtagctgact acttaggtaa
74641 ctatgatgac tataatagtg ttgtcttaga cttaagagat ttagacttat gttttagtgc
74701 tatagaatta caattacctc taatcaaaaa ggaggctaac gtataatgag atttaagaag
74761 cacgtagttc aacatgaaga aacgatgcaa gcaatagcac agagatacta tggtgatgtg
74821 agttattgga tagacctagt agagcataat aatttaaagt accctattt agtagaaact
74881 gatgaagaaa aaatgaaaga ccctgaacga ttggcttcta caggtgatac actgattata
74941 cctatagaat ctgatttaac agatgtatca gcaaaagaaa ttaattctag agataaagat
75001 gtactagttg aattagcttt aggaagagat ttaaatatta ctgcagatga aaagtatttt
75061 aatgaacatg gtactagtga taatatacta gcattcagca caaatggtaa tggagattta
75121 gatactgtaa aaggcataga taatatgaaa cagcaattac aggcacgttt attaactcct
75181 agaggttctt taatgctaca tcctaattac ggttcagatt tgcataattt atttggtctt
75241 aatatacctg aacaagctac attaatagaa atggaagtat tgagaacatt aacatcagat
75301 aatagagtaa aatctgctaa tctaattgat tggaaaattc aaggtaatgt ttattcaggt
75361 caatttcag tggaaataaa atctgttgaa gaatcaataa attttgtctt aggacaagat
75421 gaggaaggaa tttttgcttt atttgaatag gaaaggatta aattatgaaa actagaaaat
75481 taactaacat actatcaaaa ttaatagata agacaatggc aggtacaagc aagataacag
75541 acttactcc tggttcagct tctcgttcat tattagaagc tgtatcatta gagatagagc
75601 aattctatat tctaacaaaa gaaaatattg attggggtat acaagaaggt atcattgaag
75661 cttttgattt tcaaaaaaga caatctaaaa gagcttatgg tgatgttact attcaattct
75721 accaacccct agatatgaga atgtatatac ccgcaggaac aactttact tcaacacgac
75781 aagaataccc tcagcaattt gaaacattag ttgattatta tgcagagcct gattctactg
75841 agattgttgt tgaagtttat tgtaaagaaa caggggttgc aggtaatgtt cctgaaggaa
75901 caattaatac tatagcatca ggttctagtt tgattagaag tgttaataac gagtattctt
75961 ttaatacagg aactaagaa gagagccaag aagactttaa gcgcagattc cactctttg
76021 tagaatctag aggtagagca actaataaat cagtaagata tggtgcactg cagatacctg
76081 atgtagaagg tgttttatgtt tatgaagaaa caggacatat tacagtattt gctcatgata
76141 gaaacggtaa tttatcagat accttaaaag aagatataat tgatgcttta caagactata
76201 gaccaagtgg tataatgtta gatgttacag gtgtagaaaa agaagaagtt aatgtttctg
76261 ctacagtaac tatatctaat aaatctagaa ttggtgatac attacaaaaa catatcgaaa
76321 gtgttattag aagctatta aataatttaa aaacttctga tgacctaata attacagacc
76381 ttattcaagc tataatgaat attgatgatg tattaatata tgatgtgtca tttgataacc
76441 tagatgagaa cattatagta ccgccacaag gaattattag agcaggagaa ataaaagtag
76501 aactaaagta aagagaggtg aaacttaagt cgtggctaat tttttaaaga atcttcatcc
76561 attattaaga agagatagaa ataaaaaaga taatcaagac cctaaactttg ctctgataga
76621 tgcactcaat gaagagatga atcaagtaga gaaagatgct atagaaagta agttacaatc
76681 ttctctaaag acatctacca gtgaatattt agataagtt ggggattggt tcggagttta
76741 tcgtaagacc gatgagaaag atgatgttta tagagcaaga attataaaat atttactctt
76801 gaaaagagga actaataatg ctataataga tgctataaaa gattatttag gtagagatga
76861 tattgatgta agtgtatatg aacctttac aaatattttc tatactaaca aatcacattt
76921 aaatggtgaa gaccacttaa tgggatacta ttatagattt gctgttatta atgtctctat
76981 aggtgattat ttccctgtag agattataga tgtaattaat gaattcaaac ctgcaggtgt
```

```
77041 aactctatat gtcacttatg atggggcttc tactattaga ggtggagcaa ttattaagtg
77101 gttagatggg ttacctaaaa tagaaacata ccaagagttt gatagattta caggttatga
77161 tgatacattc tatggtcata ttaatatgaa tcaaagtaaa gatactgata acagttcatc
77221 agatatttt aaaacaaacc atagcttaat taatagttta gatgttttaa caggttcatc
77281 tagtgtaggg agacagtata ttaactacgg atatgtaaca tcatatgttt ataatccagg
77341 tatgacatct tctgtaaatc aaataagcgc tagtacagaa ggtagaggtc aagaagtacc
77401 tactgactat tatatgtata ctagtactaa gaataacaat acagtagaac ttagtatgca
77461 aactacttcc ggtgtgtctt atttatataa taactttaat tttagggact atatgagtaa
77521 atatagacct caagtagatt tacaatctga tgaggctaga agaattgtat ctgattatat
77581 aaaagaatta agtattgatt actatcttag tgctgtgata cctcctgatg aaagtataga
77641 aattaaacta caagtttatg attttctat taatagatgg ctacagtat caattaataa
77701 tttatctttc tatgaaaaaa atatcgggag caatatagga tatataaaag attatctaaa
77761 cagtgaatta aatatgttta ctaggttaga gataaatgca ggtaaaagag attcagtaga
77821 tattaaagtt aattacttag atttaatgtt ttattactat gaacgaggta tttatacaat
77881 aaaaccgtat aaagcattaa tagaaaatta tttagatata tctagagaga cttatgtaga
77941 agcatttaaa atagcatcat tatctaatgg agatattata actaaaacag gttttcagcc
78001 tatagggtat ttaaaactag ttggtaatta tgaaaataca atacctagca caataaatat
78061 agtagctaaa gatacagata ataaccctat agaatctaat gaattagatg tatataatac
78121 agtagagaat agaaattat tacaatctta taaggtgta aatacgatag ctagagaaat
78181 aacttctaca aaagagttta ctgtatcagg atgggctaaa gagatatact caactaatta
78241 tctttctaaa gtattaaaac caggtaaagt gtatacgtta tctttgata tggaaataac
78301 aggtaatgac ccaactctta aatcttattc tgataatcat ggtatatatt tatacagtaa
78361 tactaaggga attgttgtta atggtgttaa atctatggaa cgtactatag gtaacaaagt
78421 atccgtaact caaacttta cagccctac tattactgac catagattac taatatatac
78481 tggaagatat acatctgatg gtaaagcatc aactcctcca gtgttcttta atacagttaa
78541 aattacggaa ttaaaattga ctgagggttc ttctaagcta gagtactcac ctgctccgga
78601 agataaacct aacgtaatag aaaaaggaat taaattaat aatatcctaa ctaatataca
78661 gactttaagt attaattcgg atactatctt aaaaaatgta actttatatt attcttacta
78721 tggtgatagt tgggtagaac taaagactct aggaaatatt agtactggag aaacaacaga
78781 aaccaataac ttaatagatt tatatggatt acagacagta gattattcta atataatcc
78841 aatgtctaaa gtatcattac gttccatttg gaatgttaag ctaggtgaat tgaacaatca
78901 agaaggttct ttatataata tgcctaatga ttactttaat gctgtatggc aggatataga
78961 taaattatca gatatgagc taggttctat gagaatggtt aaagacactg agggcggagt
79021 attcgatgga gctacaggtg aaattattaa ggctactcta tttaatgtcg gtgcttatac
79081 tgatttagat atgttagcct atacttgac taattatact gaaccgtaa cgttaggctc
79141 tagtcgatta ataattgagc taaaagaaga actactaaca tcagaatcat ttaatgtcga
79201 taatgaatt aaagtaattg actcaatata tgaggagtta ccaaatacaa gcattattaa
79261 aaatggattt gttgaaagag aagttacagg ttctaaatat ttagattacg gtttatga
79321 gcctatagaa gatggtacta gatataaact tattgtcgaa ggagaattta aagataatat
79381 agaatttata tctttataca attctaaccc taactttaat gaaacattta tatatccatc
79441 agagataatt aatggagttg ctgaaaaaga atttattgca aaaccatcta ctgaagacaa
79501 accaaggtta aatacagatg ttagaatata tatacgacct tatgattcaa ctatctctaa
79561 agtaagaaga gtagaattaa ggaaagttta ataataagt tgacagaaag ttaataatat
79621 ggtatactta taaagtaata tttagtgggt ataccatgtt atattaataa agaaaacaac
79681 agatgaaagg aattaaaaaa tatggcaatt gcaacgtata attctcatgt tgagttagca
79741 aaatatctag ttagtaaagc tgattcagtt tacttaacaa ttggaaagag cacaccgtgg
79801 tctaatgaaa caaacccacc gcaacctgat gaaaatgcaa cagtattaca ggaggttatt
79861 ggatataaaa aagctactaa agttacttta gttagaccctt ctaaatcacc tgaagatgat
79921 aataagaatt taatttctta tggtaataaa tcgtgggtag aagtaacacc tgaaaatgct
79981 aaagctgaag gagctaaatg ggtttactta gaaagtagta ttgttggtga cgaactacct
80041 cttggaacgt acagacaggt aggatttgtt atggacttag tagcaaaaag tggtattagt
80101 aaatttaact tagtacctag tgaagtagaa tcaactggaa cattattatt ctttgataat
80161 aaacaattcc aaaatagaag tgagcagaca actgctaaag aaagatttat tgtagaagtt
80221 taaaggagga tgattattta tggtattcac attagaggat ttcgtgggag attggcgaca
80281 gacggcaggt tataacttag accaggtttt agagcaaggt ggtgtatctt ctttgtttca
80341 gaacttggga gtcagtgtta cacctattca gcgtatagtc ttgagtggtg agaacggatt
```

Figure 16 (contd.)

```
80401 aaagattgat atccatgtca ttattccta cgaaggattg tcaggagatc aaatgggaca
80461 gatcgaaaag attcaagg tagtgtaccc agtcgatgac caccacttca aggtaatatt
80521 gcactatggt acattggtaa tcgacggagt aacacctaac atgatagact atttcggaag
80581 accttacgag ggtatcgcgg tcttcgatgg taagaagatt actgtcacgg gaactttgtg
80641 gaacggcaac aaaatcatag acgagagatt aataaaccct gacggaagtt tgttgtttcg
80701 agtgacaata aacggagtga ctggttggag attgtgcgaa cgtatattag cttaataaag
80761 aaagggagat aattctaaat ggcaattaat tttaaaggtt caccttattt agatagattt
80821 gacccgtcta aagatagaac aaaagtatta tttaatcctg atagacctct acaacaggca
80881 gaattaaatg aaatgcagtc tatagaccaa tattatttaa aaaatctagg tgatgcaata
80941 ttcaaagacg gagataaaca atcagggctt ggattcacat tgtctgaaga taatgtattg
81001 acagtaaatc ctggttatgt atatatcaat ggtaaaataa gatattacga taatgacgat
81061 tcagttaaaa taactggcgt aggtaaagaa actattggta ttaaattaac agaacgtatt
81121 gttacacctg atgaagatgc tagcctatta gaccaaacta gtggagtacc aagttacttc
81181 tctaaaggtg cagatagatt agaagaaaag atgtcattaa cagttaatga cccgacatca
81241 gcaactattt atactttcat ggatggggat ttatatattc aatcaactaa tgctgagatg
81301 gataaaatca acaaagtatt agctgaacgt acttatgatg agtcaggttc atataaagta
81361 aatggttttg aactattttc agaaggtaat gctgaagatg atgaccacgt ttctgtagtt
81421 gtagatgcag gtaaagccta tgtaaaaggt tttaaagtag acaaacccgt atcaacaaga
81481 attagtgtac ctaaatctta tgacttagga acagcagaaa atgaaagtac tatctttaat
81541 aagtctaata actctattag tttagctaat agccctgtaa aagaaattag acgtgttaca
81601 ggtcaagtac ttattgaaaa agaacgagtt acaagaggag ctcaaggtga tggtcaagat
81661 ttttcttcaa ataatacagc attgaaatt gtaaaagttt ggactgaaac aagccctgga
81721 gttactacaa aagagtataa acaaggagaa gacttcagat taacagatgg tcaaacaatt
81781 gattggtcac ctcaaggtca agaacctca ggaggtactt catactacgt ttcttataaa
81841 tataacaaac gtatggaagc cggtaaggat tatgaagtaa caactcaagg tgaagggtta
81901 agtaagaaat ggtacattaa ctttacacct tcaaatggtg ctaaacctat tgaccaaaca
81961 gtagtattag tagactatac ttactacttg gctcgtaaag attcagtgtt tattaataag
82021 tatggtgata ttgcaatatt acctggtgaa cctaatatta tgagattagt tacaccacca
82081 ttaaacacag accctgagaa tttacaatta ggtacagtta cagtattacc tgattcagat
82141 gaagccgtat gtatttcatt tgcaatcact agattgtcta tggaagactt acagaaagtt
82201 aaaacaagag tagataactt agagtataac caagcagtaa atgtctaga tgatggtgct
82261 atggaaggac agaaccctct aacattacgt tcagtattca gtgaaggttt cattagtctt
82321 gacaaagcag acattacaca tcctgacttc ggaattgtat ttagttttga agatgcagaa
82381 gctactctag cttatacaga agcagttaac caacctaaga ttattccagg agatacaaca
82441 gctcatattt ggggtagatt aatttcagca ccatttactg aggaacgtac aatctaccaa
82501 ggtcaagcat cagaaacatt aaatgttaac ccttataata ttcctaacaa acaaggtgtg
82561 ttaaaattaa cacctagtga ggataactgg attgatactg aaaatgttac aatcactgaa
82621 caaaaaacta aaaagtaact atgaaacgat tttggagaca taatgaaagt tactatggtg
82681 agactgagca ttacttgtat tctaacttac agttagatgc aggacaaaag tggaaaggtg
82741 aaacttacgc ttatgataga gagcatggtc gtaccggtac tttattggaa tcaggaggac
82801 aacgtactct agaagaaatg attgaattca ttagaatcag agatgtatcc ttcgaagtta
82861 aaggactaaa ccctaatgat aataattat atttattatt tgatggagta agatgtgcta
82921 taacacctgc aactggctat agaaaaggct ctgaagatgg tacgataatg acagatgcta
82981 aaggaacagc taaaggtaag tttactattc ctgcaggtat tcgttgtggt aaccgagaag
83041 ttacacttaa gaatgctaac tctacaagtg ctacaactta cacagcccaa ggacgtaaaa
83101 aaacctctca agatattat atcagaactc gtgtaacagt aaacttagta gacccgttag
83161 cacaatcatt ccaatatgat gagaatagaa ctatatcatc attaggatta tactttgctt
83221 ctaaggtga taacaatct aatgttgtta tccaaattag aggtatgggt gaccaaggtt
83281 atcctaataa aacaatctat gcagaaacag ttatgaatgc tgatgatatt aaagtatcta
83341 ataatgctag tgctgaaact agatatact ttgatgaccc tatgatggct gaaggcggta
83401 aggagtacgc tattgttatt attactgaga acagtgatta tacaatgtgg gtaggtacta
83461 gaactaagcc taaaattgat aaacctaatg aggttattc aggtaatcca tacctacaag
83521 gtgtattatt cagttcatca aacgcatcaa catggactcc tcaccaaaac tctgaccta
83581 aatttggtat ttatacttct aaatttaatg agacagcaac gattgaattc gaaccaatta
83641 aagatgtatc agcggataga atagttctta tgtctacgta cttaactcct gagagaacag
83701 gatgtacgtg ggaaatgaaa ttaattctag atgatatggc atcttctaca acattcgacc
```

Figure 16 (contd.)

```
83761 aattgaaatg ggagcctatc ggtaactatc aagacttaga tgttttaggt ctagcaagac
83821 aagttaagtt aagagcaact ttcgaatcta atagatatat ctcaccatta atgagctcta
83881 gtgatttaac attcactaca ttcttaacag agttaacagg ttcatatgtt ggtagagcta
83941 ttgatatgac agaggctcct tacaatacag taagatttag ttatgaagct ttcttaccta
84001 aaggtactaa agttgttcct aagtattctg cggatgatgg aaaaacttgg aaaacattta
84061 ctaaatcccc tacaactact agagccaata atgagtttac acgctatgtc attgacgaga
84121 aagtaaaatc atcaggaaca aatactaaac tacaagttag attagattta tcaactgaaa
84181 atagcttttt acgtcctcgt gttcgtagac ttatggttac tactagggat gaataaaacta
84241 gaggggttga ttgacccctc ttatttaat aaggagagat ttatatgcct agagaagtta
84301 gagaccctta ttctcaagct aaattatta tacctacagt tgaggaaaaa tcaattaagg
84361 aattagaaaa aacatacaaa gaaaaaattg atgaagctac taagttaatc aatgaattaa
84421 agaaagagag aggagaaaaa tagatggcat ttaactacac gcctcttact gaaacacaga
84481 agttaaaaga tatgtatcct aaagttaatg ataggtaa cttttaaaa acagaagtta
84541 accttagtga tgtaaaacag atatcacaac ccgacttaa taatattta gcatctatac
84601 ctgatagtgg taactattat gtaactaatt caaaaggtgc tcctagtgga gaagctacag
84661 caggatttgt aagattggat aaaagaaatg taaattatta taaaatttac tattcaccat
84721 atagcagtaa caaaatgtat atcaagactt atgctaatgg tactgtatat gattggatta
84781 gttttaaatt agatgaaggt agcttataca atgaaggtaa tactttgaat gtaaaggaac
84841 ttactgaatc cacaactcaa tatgcaacac tagttaatcc tccaaaagag aacttaaata
84901 caggttgggt taattacaaa gaaagtaaaa atggtgtttc ttctttagta gaatttaacc
84961 cggttaactc cacttcaact tttaagatga taagaaagtt accagtacaa gaacaaaagc
85021 ctaacttatt gaaagatagt ttatttgttt atcctgaaac tagctattct aatattaaaa
85081 cagataactg ggatacgcct ccatttttggg gatattcttc taatagtggt cgttcaggag
85141 ttagatttag aggagagaat acagtacaga tagatgatgg gtctgatacg taccccttcag
85201 tagtttctaa taggtttaaa atgggtaaag aacttctgt aggtgatact gtaacggtat
85261 cagtatatgc taaaattaat gaccctgctt tacttaaaga taacttagtt tactttgaat
85321 tagcaggata cgatactgta gatgatacta gtaaaaatcc ttatacagga ggacgtagag
85381 aaataacagc aagtgagata acaactgagt ggaaaaaata ctctttcaca ttcactatac
85441 ctgaaaatac aatcggagca tcaggcgtta aagttaatta cgtatcttta ctactaagaa
85501 tgaattgttc atctagtaaa ggtaatggtg ctgtagtata ctatgcctta cctaaattag
85561 aaaaatcatc taaagttaca ccatttatta cacatgaaaa tgatgttcgt aaatatgatg
85621 agatttggtc taattggcaa gaatttatta gtaaagatga attaaaaggt cactcccctg
85681 tagatattga atataatgat tattttaaat atcagtggtg gaaatctgaa gttaatgaaa
85741 agagtttaaa agatttagct atgacagtac ctcaaggata tcatacattt tattgtcaag
85801 gctctattgc cgggacgcct aagggacgtt ctattagagg aaccattcag gtagattatg
85861 acaaaggtga cccatataga gctaataagt ttgttaaaatt attgtttact gacacagagg
85921 gtattcctta cacattatat tatgtggtt ataaccaggg ttggaaaccc ttaaagcaat
85981 cagaaacttc tactttacta tggaaaggta gtttagattt tgggtctacg gaagctgtta
86041 acttaaatga ctcattagat aattacgatt taattgaggt aacttattgg actcgttcag
86101 caggacattt ttctacaaaa agattagata taaaaaatac atcaaattta ctgtatatta
86161 gagattttaa tatttcaaat gatagtacag gttctagtgt agactttttt gaagggtatt
86221 gcactttcc tactagaaca tcagtacaac ctggtatggt aaaatctata tcttagacg
86281 ggtctacaaa tacaacaaaa gtagcatcat ggaatgaaaa ggaacgtata aaggtataca
86341 atattatggg aattaataga ggataaaagaa aggtggaata aaaaaactat ggctgttaaa
86401 tatgatatag gtaataatga gatagtatta catttaagag aaggtaaata taacaggg
86461 tttacaacag taggagggta tgataaggag ttaggacaag taaaagttaa tagagaaatc
86521 ttacctgctt acttctttga taattttgcc tatgaaagat atttgtatta tagtaaacct
86581 gaagaggtta tagaaaataa aaactatgta ccaccacaaa tcaatgatga tgatgaggaa
86641 tcccaacaaa ttactgtacc taagaacaa tatgatagtt taaagaaga actagagctt
86701 atgagaaaac aacaagaagc tatgatggaa atgcttcaaa agctcttagg tcaaagggg
86761 taattataaa tggcattaaa tttactaca ataacggaaa acaatgttat tagagacctg
86821 actactcagg tcaataacat tggaagaa ttaacaaaag aaagaaatat attgacatt
86881 accgatgatt tagtttataa ttttataaa tcacagaaa ttaaactaac tgatgataaa
86941 ggattaacta aatcttatgg aaacataaca gcccttgag atataaaaga acctggttat
87001 tactatatag gtgctagaac attagcaaca ttattagata gacctgatat ggaatctctt
87061 gatgttgttt tacatgtagt acctctgat acttctagta aggtagttca acatttatat
```

Figure 16 (contd.)

```
87121 acactatcta ctaacaataa ccaaattaaa atgttatata gatttgtctc aggaaactct
87181 agttcagaat ggcaattat tcaaggatta cctagtaata aaaatgctgt tatatcagga
87241 actaatattt tagatatagc ttcaccaggt gtttactttg ttatgggaat gacaggagga
87301 atgcctagtg gagtaagctc cggattttta gacttaagtg tagatgctaa tgataataga
87361 ttagctagac taactgatgc tgaaaccggt aaagaatata ctagcattaa gaaacctaca
87421 ggaacataca cagcctggaa aaaagaattt gagccaaaag atatggagaa atatctacta
87481 agtagtatta gagacgatgg tagtgcatca ttcccactcc tagtttatac tagtgatagt
87541 aaaacatttc aacaagctat tatagaccat atagatagaa caggtcaaac aacctttact
87601 ttctatgttc aaggcggtgt atccggttcc cctatgtcga atagttgtcg agggttattc
87661 atgtcagaca cacctaatac ttctagttta catggtgttt acaatgctat aggtacagat
87721 ggtagaaatg taacaggttc agtggtaggt agtaattgga cttcaccaaa aacatcccct
87781 tctcataaag aattatggac aggagcacaa tcattcttat ctacaggaac tactaagaat
87841 ttatcagatg atattagtaa ctactcttat gtagaagttt atactacaca taagacaaca
87901 gagaagacta aaggtaatga caatacagga actatatgtc ataagttta tttagatggt
87961 agtggaactt acgtttgttc aggtacattt gttccggggg atagaaccga tacaaaaccc
88021 cctatcacgg agttttatag agtaggtgta tctttaaaag gttctacatg gactcttgta
88081 gatagtgcag tacaaaatag taaaactcaa tacgttacaa gaattatagg tattaatatg
88141 ccatagacta ggagaaaattt cctagtcttt ttttttcttg acttgaaaag gattctgtgg
88201 tatactataa ctcgtgtaag gatataagga gattaaaatg agattaagaa ttaagaactt
88261 atatacctat gtagaatttg aggaggatga taaatactta aaagatatat tttaaagag
88321 agtccatacg actataggag caagacaaga aggatttcag tacagccctg cgtacaaaag
88381 aggtagttgg gatggttatg tagattttta tgtttatgag gaagataaat tcccactgg
88441 actttatttt aaaattgagt tattattagg tgagctacaa tcaaggtata atttccagtt
88501 tgaaacaatt gatgagcgtg atgaaagttt cttatctgaa gaagatatgt atgatgagat
88561 aacattgctt gataataatg tcggtcaaat taccttaaga gattaccaat atgaagcagt
88621 gtacaatagc ttaacattt acaatggtat tgctcactta gctactaatg gtggtaaaaac
88681 tgaggttgct agtggtatta tagaccaatt attacctcaa ttagaaaaag gtgagagagt
88741 agcattcttc acaggctcta cggagatatt ccatcagtct gcagataggc tccaagagcg
88801 tttaaatatt cctattggta aagtaggtgc aggtaagttt gatgttaagc aggttacagt
88861 tgtaatgata cctacttaa atgcaaacct taaagaccca acacaagggg taaaggttac
88921 gcctaaacaa aatattagta aaaagatgc tcaagagata ttacctaaat ttgaaggtgg
88981 aacaaatcaa aagaaattac taaaagtatt acttgataac acaacaccta aaacaaaagt
89041 agaacaaaat gtattaagtg ccttagagat aatttaccaa aatagtaaga cagatgcaga
89101 agttttata aacttaagaa atcataatgc acatttcaa aaaattgtta gagaaaagaa
89161 cgaaaagaaa tatgataaat atcaagatat gagagatttt ttagactcag ttacagttat
89221 gatagttgat gaggcacacc attctaaatc tgattcttgg tacaataatt taatgacatg
89281 tgaaaaagct ttatatcgaa ttgcattaac agggtctata gataaaaaag atgaattact
89341 ttggatgaga ttgcaggcgc tatteggtaa tgttattgca cgaactacta ataagttttt
89401 aattgatgaa ggtcattctg ctagaccaac aataaatatt atacctgtag ctaatcctaa
89461 tgacatagat agaattgatg attataggga agcttacgat aaaggtataa caaataatga
89521 ttttaggaat aaaacttattg caaaactaac agaaaagtgg tataatcaag ataaaggtac
89581 attgattatt gtaaacttca ttgaacatgg agacacaata tcagaaatgt taatgattt
89641 agatgtagag cattacttct tacatggaga aatagactct gaaactagga gagaaaaatt
89701 aaacgatatg agaagtggta agcttaaagt aatgatagct acatcactta ttgatgaggg
89761 tgtagatata tcaggtatta atgcactaat attaggtgca ggaggtaagt cattaagaca
89821 aacattgcaa cgtattggtc gtgctttacg taagaaaaaa gacgataata caacacaaat
89881 atttgatttt aatgatatga caaatagatt tttatatact catgctaatg agcgtaggaa
89941 aatttatgaa gaggaagatt ttgaaataaa agacttagga aaataggagg gtaagagatg
90001 gcaacaaaaa cacaaagaaa gctataccaa tatctagagg aaaatgctac agaaaataaa
90061 tttcatattt ctactaagaa agagctagca gattctctag gtgtttccat ctctgcttta
90121 tccaataacc ttaaaaagtt agaagaagaa aataaagtcg ttactgtttc taaagagga
90181 aaaaacggcg gggtaataat aactttagtt agagagtatg acacagaaga attgaaagaa
90241 ttcaataatt ctacagataa tattattact tccgatttac agtatgctaa ggcattaaga
90301 gaaagcact tccttcta tagatatgag agaaaagaac aacgtagacg tactaagata
90361 gaaatggcac aatacaatgc cattaaggat gagaagagaa gaattatagc agatatgaat
90421 ttctattcag aaggtcttcc ttatccttct aaagatattt ttaatatgtc ctatgacccg
```

Figure 16 (contd.)

90481 gaagggtttt ataaagcgta catcttatgt aagttatacg accaatatgc tatttctcat
90541 atggatgcta aacatacaag tcatcttaaa gcaatgagta aggcaacaac taaagatgaa
90601 tacgactacc atcaacatat gtctgaatac tatagaaata aaatgattca aaatttacct
90661 agaaatagcg ttagtgataa tttcttggt agtaaaatgt ttaatacttt ttataattt
90721 tatttaaaaa taaagataa aaatattaat gtatttaagt atatgcaaaa tgtatttaaa
90781 aatgtaacat tttattacga gaacggtatg caacctaatc caatacctc tcctaactc
90841 tttagctcag ataagtattt taaaaactat aataattata ttaaaggaat aaaaaaaggt
90901 gttaacagta ctaatagaca cctaggtgat acagacagca tcattaattc atcagactat
90961 gtgaaaaacc ctgctgtatt acatctacac caactatata ctacaggatt aaattctact
91021 ttacatgata ttgatactat gttgaacaa gccttagacc ttgaaaatgc ctcctatgga
91081 ttatttggag atatgaaaca tattattta ctacagtata attctatgat tgaagaagaa
91141 attaagaatt tacctagaga agaaaaggat attattaata aatatgtaaa acaatgcata
91201 attaatgatt attcaccaac aagtatttca ccttctgcaa ggttatcaat gttactatg
91261 cagaaagagc atatagttta caataagcag ttaaataaag gaatcaagag agaggattta
91321 ttaccattaa gtctaggagg tatagtgaat aaagatttat tgagtggtat ggatatacaa
91381 aacttagaac agaatggtaa tgaataccta tatatgagac aacatacttc aacttattat
91441 atattaagaa tgtttggtga ctatttaggg tatgaggtaa acttaagaga agtaaaatat
91501 attgtagaga aatataatttt aattgataaa ataccattga caaagagggg tatgttggat
91561 tataataaac ttatacattt agtagaggaa gaggttaata actatgagta agaagataaa
91621 ggagcttatc cttcataaat caatgaagga tatacatttt gcaagagaag tattagataa
91681 cttacctaag aatctatttt cagcagagtc tgaggacatg ggttacttat ttacagctat
91741 aaagagaaca gcacatatttt ccgataagat gtcaaatgaa gcattagcaa ttaaagtaga
91801 acagcttatg ggtaataata aggaagatga agagaaagta accaagacat taacttactt
91861 agaagattta tataagtag acgttaatga aaaagatgaa tctgttaatt atgaaataga
91921 gaagtatatt aaaacagaaa tgtcaaagat agttttagtt aaatttattg cagaaaataa
91981 acaagaagac tctgataatc tacatgaact tgtagacaaa ctaaagcaaa tagaagtaag
92041 tgacatctca ggaggtaatg gggagttat tgacttcttc gaagatacag aaaagaaaca
92101 agaactattg agtaattag ctacaaataa attctctact ggatttactt ctattgacaa
92161 ccatattgaa ggtggtatag caagaggaga ggttggatta atcatagctc ctaccggtag
92221 aggtaaatca ttaatggctt caaacttagc taagaattat gttaaaagtg gattaagtgt
92281 tttatatatt gccttagagg aaaaaatgga tagaatggtt ttgcgtgctg agcaacaaat
92341 ggcaggagca gaaaagagtc aaattgtaaa tcaggatatg tctttaaaata ataaagttta
92401 tgatgcaata caaaatcatt atcagaagaa tagaaagtta ttaggtgact tttatatttc
92461 taaacatatg ccaggtgaag ttacaccaaa ccaattagaa caattattg tcaatacaac
92521 aattaagaag gataaaaata ttgatgttgt tattattgac tatcctcact taatgagaaa
92581 tccttatgct aaatatcatt cagaatcaga tgcaggaggg aaattgttg aagatattcg
92641 tagattatca cagcaatatg gatttgtttg ttggacgtta gctcaaacta accgtggtgc
92701 ttatggttca gatgttatta caagtgagca tgtagaaggt tctcgtaaga ttgtcaatgc
92761 tgttgaggtg tctttagcag taaaccaaaa agatgaagaa ttcaagagcg gtttcttaag
92821 attgtattta gataaaattc gtaatagctc taacacagga gaacgatttg ttaatcttaa
92881 agtagaacca actaagatga ttgtaagaga tgaaacacct gaagaaaac aagagcatat
92941 acaattgcta tcagataatg gaaaagaaga cacaagtaaa tttcaaaata aagataataa
93001 aatagaagct ataaataaca cattcggagg attaccggga gtttaattt ttaaaatata
93061 caacttgaca tttatatgt taggtggtat aattatttta taagaataa aggagagatt
93121 aataatgaaa tttgtattct ttacagatag ccactttcac ttatttacta actatgctaa
93181 acctgatgag cagtatgtga atgatagatt tagagaacag atacaagctt tacagaaaat
93241 gtttgatatt gcaagagaag aggatgcaac agttatattt ggtgggatt tattccacaa
93301 acgtaacgca gtagatacta gagtatataa taaggtattt gaaacattcc aacttaatag
93361 agatatagaa gtactaagt taagaggtaa tcatgattca gttacaaata gtttatatac
93421 agattctagt atagaaccti tcggttactt acctaatgta gaggtttgta aaaaccttga
93481 tactttaggg tttttaggag aagaacagga tattaatatt gttatggctc cttatggaga
93541 cgagactgaa gaaattaaag agtttatta aaataaatat gtagaagata gagtaaatat
93601 cttagtaggt cattaggtg tagaaggctc tttgactgga aaagggtctc atagattaga
93661 aggggcattt ggataccagg atttattacc tgataaatat gatttcattt tactaggtca
93721 ttatcaccgt agacaatatt tccaaaatcc gaatcattt tatggtggtt cattaatgca
93781 acaatcatt tctgatgagc aagaagctaa tggtgttcat ttaatagata cagaaaaat 93841 gactacagaa ttcatcccaa tccatacacg tagatttatt actattcaag gagaagatat
93901 tcctgagaac tttgaacagc taatcgagga agataatttt attagggtta tcggtacagc
93961 aaatcatgct aaggttttag aaatggatga cagtatgaaa gataagaatg ttgaagttca
94021 aattaaaaaa gagtatactg tagagaaacg tattgatagt gatgtgtctg atgacccttt
94081 aacaattgct agtacctatg ctaaacaata ctcacctgaa tcagaacaag aaatacttga
94141 gtgtttgaag gaggttttat aatgaaaaaa tatagagaat atctaaataa gacagatgca
94201 gaaaatttag cagaggattg ggagaaagta accgaagatt tatggaaagt gtttaaagat
94261 atgaaaccta aaattaatac attagatatc agtaatgtag taagtaaaga cttagataaa
94321 agtaaaccta ttttacaatt ccaagattca gatggagtaa tagagaatat ttgtaatgtt
94381 gaaggtttag aagatggtct aagtaaaatg aaaaagattt ttgatgatag taattttgaa
94441 aagcattatt acaatagagt agtagaccat gatgagtatt actggattga ttatggctct
94501 catcattgtt tctttagagt tacgaaaggg gataagtaat ggttgtattt aaacaagtag
94561 aagtaataaa tttttagca attaaagaag ctacgctaga gttagacaat agaggattaa
94621 ttctaattga aggtgagaat aaatctaatg agtcatttca ttcaaacggc tcaggaaaat
94681 caactttaat atctgccatt acttacgctt tatatggtaa aactgaaaaa ggactaaaag
94741 cagatgatgt agtaaataat attgagaaga aaaatacatc tgttaaactt aagtttgata
94801 ttggggaaga tagttattta attgaacgtt atcgtaaaga taagagaat aagaataaag
94861 taaaattatt cgttaatgaa aaagagatta caggttcaac aaatgacgtt accgataaac
94921 aaatacaaga tttatttggt attgagttta atacttacgt taatgccatc atgtatggtc
94981 aaggagatat ccctatgttc tctcaagcaa cagataaagg taagaaagaa attcttgaat
95041 ctattactaa gacagacgta tataaacaag cacaagatgt agcaaagag aaagttaaag
95101 aagtggaaga acaacaaaat aacataagac aggaaatcta taaactaggt tatcagttat
95161 cgacaaaaga tgagtacttt caaagagaaa tagagcagta caatcaatat aaagaacaat
95221 tggttcagat agaaaacagt aataaggaaa aagatagatt aagagaacaa gaggagaagc
95281 aaatagaagc tcaaatagag caactagctt cacagatacc aacaatacct gaagatgaat
95341 ttaagcactc agaggagtat aataaagcct ctcaaagcct agatttactt tctaataaat
95401 taacggagtt aaatcaagtt tactcagagt ataataccaa agaacaagta ctaaaatctg
95461 aaatagctac attaagcaat agtctaaatc agttagatac aaatgaccat tgtcctgttt
95521 gtggctcccc tatagataat tctcataaat taaaagaaca ggaaaatatc aataatcaga
95581 ttgagaataa gaaacaagag attactagtg tattagaaat gaaagatacg tataaagaag
95641 ctattgataa agtaaaagat aaatcacaag aaattaaaga taaatgtca caggaagacc
95701 aacaagaacg agagcacaat aataagatta acagcataat tcaagaggct tctaggatta
95761 aatcagacat tagttcatta gagaataata aaacgtattt aaaagttaaa tatcaacatc
95821 aatctgttca aggattagag agagaagaac caagtaaaga aaaacatgag gaagataaga
95881 aagaattaca agaatctatt gacaaacatg aagagaatat agtacaatta gaaactaaga
95941 aaggtaaata tcagcaagct gtagatgctt ttagtaataa aggtatacgt tcagtagtgt
96001 tagactttat tacaccattc ttaaatgaaa aagcaaatga gtaccttcaa actttatcag
96061 gttcagatat tgaaatagag ttccaaactc aagtgaagaa tgctaaagga gaactaaaag
96121 ataagtttga tgttattgtt aagaatagca agggcggagg ttcgtacaaa tccaattcag
96181 caggagaaca aaaacgtatt gatttagcaa ttagttttgc aattcaggat ttaattatga
96241 gtaaagatga gatatctacg aatattgcac tttacgatga gtgttttgat ggattagata
96301 ctatcggttg tgaaaacgtg attaaattat taaagatag acttaataca gtaggaacaa
96361 tatttgtaat tactcataat accgagctta aaccactgtt tgaacaaaca attaaaatcg
96421 taaaagaaaa tggagtatca aaactggagg aaaaataatg aaattaaaga ttttagataa
96481 agataatgca acacttaatg tgtttcatcg taataaggag cacaaaacaa tagataatgt
96541 accaactgct aacttagttg attggtaccc tctaagtaat gcttatgagt acaagttaag
96601 tagaaacggg gaatacttag aattaaaaag attacgttct actttaccat catcttatgg
96661 tttagatgat aataaccaag atattattag agataataac catagatgta aaataggtta
96721 ttggtacaac cctgcagtac gcaaagataa tttaaagatt atagagaaag ctaaacaata
96781 tggattacct attataacag aagaatatga tgctaatact gtagagcaag gatttagaga
96841 tattggagtt atattccaaa gtcttaaaac tattgttgtt actagatacc tagaaggtaa
96901 aacagaagaa gaattaagaa tatttaacat gaaatcagaa gagtcacaac tgaatgaagc
96961 acttaaagag agtgatttt ctgtagattt aacttatagt gacttaggac aaatttataa
97021 tatgttgtta ttaatgaaaa aaattagtaa atagtaagga aggatattat gaggtttgaa
97081 gactttttaa cccaagaatt aggagaacca aaagaaaata ctataggtga gctaagatac
97141 tgttgtccgt tttgtggaga aaaaagttat aagttctatg ttaagcaagc cctagactct

Figure 16 (contd.)

97201 agtaatggtc agtatcattg taaaaaatgt gatgaatcag gtaaccctat tacatttatg
97261 aagacttatt ataacattac aggtaaacaa gcttttgatt tattagagtc taagaatata
97321 gatatagaga gagccccttt acttacgacc aataataagg atttgacaga atcagagaaa
97381 cttatattaa tgcttagagg tgtgcaccaa gataaaggaa atactagtat taaacctcct
97441 agattacctg aagggtataa attattaaaa gataacttaa ataataaaga gattataccc
97501 tttttaaaat acttaaaagg tagaggtata actttagaac aaatcattaa taacaatata
97561 ggttatgtta ttaatgggag cttttataaa gttgacgggg aatccaaagt atcattaagg
97621 aatagtatta tatttttac ttatgataat gatggaaact accagtactg gaatacaaga
97681 agtatagaga agaaccctta tattaaatct attaatgctc ctgctaaaca agatgaagta
97741 gggagaaaag atgtcatatt taatttgaat atagcaagaa agaaaaagtt cttagttata
97801 actgagggtg tatttgatgc tttaaccttc catgagtatg gagtagcaac attaggtaaa
97861 caagtaaccg agaatcaaat aaaaaaaata attgattatg ttagtataga tacatcaata
97921 tatattatgt tagacactga tgcactagat aataatatag acttagctta taagttaaaa
97981 acacatttta ataagttta ctttgtacct catggtgatg aagatgcaaa tgatatgggg
98041 acaaggaaag cctttgagtt attaaaacag aaccgggtgt tagtaacacc tgaaagtata
98101 cagattaca aaatacaaca aaaacttaaa ctttaggctt gacctagag aagttttatg
98161 ttatactagt aattaagtaa ttaataaagg agaaaaaaaa taatgtcaaa taataaaaaa
98221 gatattttag aatttgtaga tgaatacatt acagctttaa gagttggtaa tgagcaacga
98281 caacatcaat tagaagaaat gggtaaagaa gaaacagcaa cattaacaga tgtagctaaa
98341 gctattacta accttatgtt aggtgttaat gagcagatga cagacttaga atataataat
98401 gagttaaact taaatatttt aattgacgct ttatataaag cagagcttat taatgaagat
98461 gtattagact acattcaaga atcaattgat aaatcacaag aagaacctaa aaatgaagaa
98521 gaaaaaggag aacaagaata atggaaaaaa atattagcac acacacaaaa ggtattagtc
98581 aagcagacat ggagaaatgg attgaagctg yagtacaagg aactgttgat ggtaaacaag
98641 ttgatgagaa aacagctaaa caattakata gaattggttc acgtagtgtt tctttagaag
98701 aagcaactcg tattgctaaa gttcttaatg ctgtaacagc tcaagaggtt acaggagact
98761 ttaatgatgc atttaatgca attgacttaa tgatgattat catggaagat gagttaggag
98821 taactcaaga aaaagtaggg aaagctaaag ataaactaaa tgaaaaacga gaagcttacc
98881 taaaagagaa acaagaagaa ttacgtcaaa aacaacaaga agaggcacag aaaaaaactg
98941 aatctgacag caatgaaaaa gtaattcagt tgaagaaaaa tgacgaacag taagaaaaaa
99001 ggggatacat tcgaacgtaa aatagctaaa gaattaactt cttggtgggg ataccaattc
99061 aataggtctc ctcaatcagg tggtgcttca tggggtaaag ataataatgc tgtcggagat
99121 atagtagtac ctcaggaagc taattttcct ttagtagtag aatgtaaaca tagagaagaa
99181 tggactatag ataatgttct tctaaacaac agagagccac atacatggtg ggagcaagtc
99241 attaatgata gtagcaaggt gaataagaca ccttgcttaa tatttactag aaatagagct
99301 cagagttatg ttgctttacc ttatgatgaa aaagtatatg aagatttaag aaataatgaa
99361 taccctgtca tgagaacaga ttttattatt gataatatta gaaaagataa atttttttat
99421 gatgtcctta taactaccat gaatggggttg acctcattta caccttctta tattatatct
99481 tgctacgaca aaaagatat aaaaccatac aagaaggtcg agtctaattt atctgaggta
99541 agtaagcatg aagatgaatt gattaatgac cttcttagtg atatataagg aaggtaagat
99601 aagtatgaca agtaaagaaa gaccattaat cgtatatttt tcaggtacag gacaaacaga
99661 aagattagta aacaaaatta atattaataa ttcatttgaa acattaggg ttaagagtgg
99721 aaaagaaaaa gtaaataaac ctttatact aataacacct acttataaga aggtgcaat
99781 acctaaacaa atagaaagat tcctagaaat taatgggagc cctaagaag ttattggtac
99841 aggaaataaa caatggggct ctaatttctg tggagcaagt aaaaagattt cagagatgtt
99901 taagattcct ttaattgcta aagtagagca atcaggacac tttaacgaga tacaaccaat
99961 attagaacac tttagtaata aatataaagt agcgtaaagg atgagagata tatggcaaca
100021 tatggaaaat ggattgagtt aaataatgaa ataactcaat tagatgacaa tggaaaaaat
100081 aaactctata aagaccaaga agctttagat gagtatttaa aatatattga agacaataca
100141 agaaagttta atagtgaagt agaaagaatt agagtattga caaaagaagg aacatatgat
100201 aaaatatttg acaasgttcc tgacactatt attgatgaaa tgactaagtt agcttacagt
100261 tttaatttta aattccctag ttcatggca gggcaaaagt ttatgaatc ttacgcatca
100321 aaacagtatg atgaaaacaa aaaacctatt ttgttgaag actatgaaca acataatgtt
100381 cgagtagctt tatatttatt tcaaaatgac tatgtaaagg ctagagaatt actagtacaa
100441 cttatggagc aaacattcca accatctaca cctacgtata acaactcagg acaagctaat
100501 agaggtgaac taagctcatg ttatctattt gtagtagatg attcaattga gtctttaaac

```
100561 tttgttgaag atagtgtagc taatgctagt tctaatggtg gtggagttgc aattgattta
100621 actagaatta gacctaaagg agctccagta cgtaatagac ctaattcaag taaaggtgtt
100681 attgcttttg ctaaagctat tgaacataaa gttagtattt atgaccaggg tggtgtaaga
100741 cagggtagtg gtgctgttta cctaaatata ttccacaatg atatcttgga tttattaagc
100801 tctaagaaaa tcaatgccag tgagtctgtt agactagata aattatctat tggtgttaca
100861 atccctaaca aatttatgga gttagttaaa gaaggtaaac ctttctatac ttttgatact
100921 tacgacatta ataaartgta cggtaagtat ttagatgagc taaacattga tgaatggtat
100981 gataagttac tarataatga tagtatcggt aaagtaaaac atgatgctag agaagttatg
101041 acagayattg ctaaaacaca attagaatca ggctaccctt atgtattcta tattgataat
101101 gctaatgata atcacccatt gaaaaaccta ggtaaagtta aaatgagtaa cttatgtaca
101161 gaaatttcac aattacaaga ggtatcagaa atttatccgt attcttacag taatcagaat
101221 gttattaata gagatgttgt ttgcacatta ggttctctta acttggttaa tgtagttgaa
101281 aaaggtttat tgaatgaatc tgtagatatt ggtacaagag cattaacaaa agttactgat
101341 attatggatt taccttactt acctagtgtt caaaaagcaa atgatgatat tagagctatc
101401 ggtttaggtt caatgaattt acatgactt ttagctaaga atatgattag ttatggttct
101461 agagaagcat tagacctagt aaacagttta tatagtgcta ttaacttcca atctattaag
101521 acatctatgt taatggctaa agaaacagga aaaccattta aaggcttga gaagtccgat
101581 tacgctacag gtgaatactt tgtaagatac attagagaat ccaatcaacc taagacagat
101641 aaagctaaga agtcttaga taaggtttat attccaacac aagatgattg ggatgaatta
101701 gctaaagcag tgaaagtaca tggttttgtat aatggttacc gaaaagcaga agcacctact
101761 caatctatat cttatgtaca gaatgctaca agtctctatta tgccagtacc tagtgctata
101821 gagaatagac aatatggaga tatggagaca tattacccaa tgccttacct aagtcctata
101881 actcagttct tctacgaagg agaaacagct tataagattg acaataaacg tattattaat
101941 acaagcgcag ttgttcagaa acatacagac caagcagtgt ctacaaatct tatgtagag
102001 tcagaaatac ctactaataa actagtatca ttatactatt atgcttggga acaaggatta
102061 aaatcattat actatacacg ttcacgtaaa ctttctgtta ttgaatgtga aacatgttcg
102121 gtttagaaag gaaatagata tggatattac acaaaaagta aaacaacata ataaaatgc
102181 tgtattaaaa gcaacaaact ggaatattga agatgacggg atgtctgata tttattggga
102241 gcaaggaatc tcccaatttt ggactcctga agagtttgat gtatcaagag atttaagttc
102301 ttggaatagt ttaactgaaa gtgaaaagaa cacttataag aaagtcctg cagggctcac
102361 agggctcgat acaaagcaag gaggagaagg tatgaacta gtatcctacc acgaaccaag
102421 acctaaatac caagctgtat ttgcgtttat gggtggtatg gaagagatac atgctaaatc
102481 gtatagtcat atctttacaa cattactaag taataagaa acaagttatt tattagatac
102541 ttgggtagaa gaaaacgact ttttaaaagt aaaagctcag tttatcggat attactacga
102601 ccaactatta aaacctaatc ctactatatt tgatagatac atggctaaag tagctagtgc
102661 ctttttagaa agtgcattat tctactcagg attttattat cctttacttc ttgcaggaag
102721 aggtcagatg acacaatcag gagctattat ttataaaatt actcaagatg aagcttacca
102781 tggttcggca gtaggattaa cagctcaata tgattataat cttctaacag aagaagaa
102841 aaaacaagca gataaagaaa cttatgaatt attagatatt cttacacta atgaagtagc
102901 gtatacacat agtctatatg acccactaga attaagtgaa gacgtaatta actatgttca
102961 gtataatttt aatagagctc ttcaaaacct tggaagagag gactatttta atcctgaacc
103021 ttataaccct attgtagaaa atcaaactaa tgtagacaga ttacgaaatg ttgatttctt
103081 tagtggtaaa gcagactatg aaaaatctac aaatatcaaa gatattaaag atgaagattt
103141 ctcattctta gatagtaaag aatacagtac tgccaaggaa ttcctataaa aaggagaaa
103201 gatattatgg atagaaaaga agcaatggat ttactaagta aagcagaaat attatttaaa
103261 aaacatgatg agttttcatg tgtaagtgat atcaatgacc ctatgaagtt attcagtaac
103321 tctaaagatg ctaaagctga tgatacgtct aaktctttc agctagagtt tatgcatgat
103381 atgaccatgt atactttatc ttatggctca ggacagctaa aacttattga tttagcagaa
103441 ggttatgaag cacaaaaagc tacartagtt aactcatttc ccgaaattat taaaacatta
103501 gaaaaggatg attcagaaga tggaaaaaat gaatagttta gtagatttaa atacagcaat
103561 tagacaaaag aaagatgtta ttgtcatgat tacacaagat aattgtgggta agtgtgagat
103621 tttaaaagt gtaatcccta tgtttcaaga gtcaggtgac attaaaaaac ctatcttaac
103681 attaaatcta gatgctgaag atgtagatag agaaaaagct gttaagttat tcgatatcat
103741 gagtacacca gtattaattg ggtataaaga tggtcagtta gtaaaaagt atgaagacca
103801 agttacacct atgcaattac aagaattaga gtcactttaa tttggaattt cctactatct
103861 gtgctatact ataatagtac aaggtagtag gatttttaa tggaaggaag atgacatatc
```

Figure 16 (contd.)

```
103921 gcaaagaata aaacattaac gatatataat agtgatagat attttaatat acacacaaaa
103981 gataaagata aaattaatga ggctattaaa gtaacacacg gtaatgaaga agaaattgaa
104041 aagaatatgg atgaattaat atctaagtct agaagatata tcatgaggga tgaaaagcat
104101 tacatgctat ttaatgagaa gtacaataat gataggctta tagaaaaagt atgtaaacac
104161 ggtggtaaag ttacatacta tactgattca gtattacctt actatgtttt aaaagactta
104221 tctagtcacc ctgactcaga agttgtttat cgtatgcgca acggtttac tgcaaaagaa
104281 gtagataata tagctttatc attcatgggt acaaaagtta ttattgatat ttctgtagta
104341 tttccttatg taaacccta tgatattatt agaagtttac atgatattaa aacaaatgta
104401 gatgaagttc atttatcatt tccacgaata ttaggggtag atgaaaaaca agaaaagttt
104461 tatttctttg atggtgaagc ttatgattta aaacccgaat ataaagtcga ttttgcagat
104521 aaaattagag tatctttatc agtatggaaa atgtatatct atatcttaac aagtagtcgt
104581 gattttgagg atgtagacaa tgtaattacg aaattaaaac aacaacgaaa gattaagata
104641 taaggtgatt atatgagtac agcaaataga agagatatag caagaaagat atcagagaat
104701 acaggttact atatccaaga tgtagaggaa atactaagtg cagagacaga tgctatttct
104761 gacttgctag aagaagggta tactaaagta aagaatcata aatttatgca aatagaagtt
104821 attgaaagaa aaggtaaaaa agcgtgggat ggtctgaata aagaatactt ccatttacct
104881 aatagaaaag ctataaaatt caaaccacta aaagaactag aagaggttat tgatagactt
104941 aatgaagaag agaaataatt ctcttctttt tttattgaca aggttaaaa tatatggtat
105001 agtattatta agttaaaaaa ggagaggaat taaatgaaag tattaatctt atttgaccac
105061 attagagaag agcattttc tgtaagtaaa gatgggagtg tgaaatctaa tgtactaaat
105121 acacctaacg gaaaaacact taagaaatta cttgagaagt gttctaactt aaagagagat
105181 aaaacaaaca gagattatga tattgatttt ctctacaatg cagtacctac acctattaga
105241 aatgactacg gtaaaatcat taaataccaa gatgttaaac aagcagaagt aaagccatac
105301 tatgagagaa tgaataatat tattattgat aattcttatg atatggtaat tcctgtaggt
105361 aaactaggtg ttaaatacct attaaatgtt acagctattg gtaaagtaag aggtgtacca
105421 agtaaagtaa ctattgaaaa tggaacatct tctcatgatg tgtgggtatt acctactat
105481 agcattgaat atactaatgt aaataaaaat agtgaacgtc atgtagtatc agatttacaa
105541 acagttggta agttgtaga gcaaggagaa gaggcattta aacctaagga agtatcttac
105601 gagttggtag ataacattga aagagtaaga gaaatattca ataaggaagt aaagaatgat
105661 aattatgatg gggtagatat taccgcatgg gacttagaga ctaactcatt aaaacctgat
105721 aaagaaggaa gtaaaccttt agtactatct ctatcatgga gaaatggtca aggtgtaact
105781 ataccttat acaaatcaga ctttaactgg gaaaacggtc aagatgatat tgatgaagtc
105841 ttagaattgc ttaagaattg gttagctagt aaagaagata ttaaagtagc acataacggt
105901 aaatgatttg ctgttgtaaa atccctctca tatcgggcat agctttaagt agctgataag
105961 agaacctaag tcctgtaata aggatagtgg taatcccgag cttacattat tggtgacaat
106021 agatggggtg tagagactga gccgaggttt tgtagaccaa ggtgagacat agtgtatcga
106081 cttaatagag gtggtacagt gaaaaagat tatatgacat cagttaaaaa taacaaaaaa
106141 gtatgtagaa gatgcaacga agaattagat ttatctaact ttaaaacata taagaagaat
106201 gataaaactt attatcaaag tatgtgtata ccttgtcgga aggaatataa taagttagat
106261 aaaactaaaa atactattaa aaaatgttat gagaaaaacg gagataaata tagaagacaa
106321 agtaatgagt ataatacttc tgacagaggt agagagctta ataaaaatag gtctaggaaa
106381 tacagagaaa acaattcttt aaaatcgaaa gctagaagct ctgtaagaac cgcattaaga
106441 aatggttctc tcataagacc tgataagtgt tcagagtgta ataaagattg catacctgaa
106501 gctcaccatc ctgattatac taaaccttta gaaataaaat ggttatgtaa atcctgtcat
106561 gaagatactc atcataaaaa ataatcacac tatgtaaatg agggacatca agcccattta
106621 ggtaactaca aacaaaccta atggtaaggg cttatgaagg tatagtccgt tctatataga
106681 aatatatagg ctaaaacgaa atatgatatt aagttcttaa tgagtactga aaactttaaa
106741 gattttgaga gtattcagga tactaaagta ggtggtacc tagctgttac ccaagaagtt
106801 aaagaatctt taagaattatc tgatttagct tatgaggtta cagatgtcgg aggctatgat
106861 aaaccattag aagactttaa attatggttt gttactaagt tattaagatt cttctcagat
106921 aaaattaaag agatacagaa agaaaataaa aagattgcta agaaagagta tgatgttaaa
106981 gctcctgaat ataagaatg gttagagaat aaattaaatg aaacagtagt agaactagat
107041 gatactgaga aaaaatttag agttagtgaa ttagagaaaa agtatatca actaggtctt
107101 tcacctgaaa ttgtaaatat gaatttagtt atggataatg atgaattcat aaatattgca
107161 gaacaatcac ctgagtacat ggggttatct gactacgcta agtcttacac gttaaatact
107221 gcaattaatt taattaatga gtatagagat gtaaaagatg tagttaatga tattgacgga
```

Figure 16 (contd.)

```
107281 ggtaacttta attatgattg gttccctatt gagttaatgc atccatacgc atcaggagat
107341 actgatgtat gtagaagaat tcattgtgat gtaattaaga aacttaaaga acaagataga
107401 cctaagtcaa tgcatttatt agaagttaat tacccaagac ttactaagtc tttagctaga
107461 attgaatcaa atggtttata ttgtgactta gattatatga aagaaaatga tgagtcatac
107521 gagtctgaga tggctaagaa ccatgctaca atgagagagc actgggctgt taaagaattt
107581 gaagaatacc aatacaatct ttaccaaatg gcgttagaag aacatgagaa aaagccaaaa
107641 gatagagata aagatatcca tcagtacaga gataaattta aagatggtaa atggatgttt
107701 tccccaagtt ccggagacca taaaggtaga gtaatttatg atatttctagg aattcaatta
107761 ccttatgata aagaatatgt caaggaaaaa ccatttaatg ctaatgttaa agaagcagac
107821 cttacttggc aggactataa aacagacaag aaagctattg gttatgcgtt agataattta
107881 gaattaaaag atgatgttaa agagcttctt gaattactta aatatcatgc tagtatgcag
107941 acaaaacgta attcatttac taagaaatta cttaatatga ttaataaaca aaaacgaaca
108001 ttacatggtt cttttctga gacaggcaca gagacatcaa gactaagtag tagtaaccct
108061 taaattgggg ttgtaaaact ttgttaactg cgggaagaga ctcgttaggt cttaactact
108121 aacttataat ggaaacatat ataagggcaa acagtaacgt gtttgatata gtaaaaggt
108181 taagaataga gagaatccgc atccaagacc ctgaaagtat ataaaagtat gggtaaggtt
108241 caacgactag gtgttgagac aatacaatca atacacaccc acgaaagcaa aggtattatt
108301 tctgtggtag ggaataataa ggagagttat atgaaagaga tttggaagaa agtagtagga
108361 tttgaaaact acgaggtaag taataaagga aaagtaagga atataaaaac taactatatt
108421 ttaaagccgt ggataataaa ttccggatat gagcaagtat ctataggtat tgctaatgta
108481 ttagtacata gattagtggc tatgacattt ataccctaccg acagctatag tatagttaac
108541 catattgata ataataaatt aaataactgt gttgaaaatt tagaatgggt aagttacaaa
108601 ggtaatagtc ctcacgctaa taagcaagga agattgaata cttatagtgc aagagaaaaa
108661 cttagttctg tatctaagaa agccatttat caaaaagata tggaaggtaa catcattaag
108721 ttatgggatt caccaagtga agctgaaaaa gaatctaatg ggtactttaa aagtactaag
108781 attagttccg ttgctcacgg taaacgtaag catcatagaa gttatacttg ggaatacgta
108841 tataaggatt caaagagaag tttaaataag tctattaata tgtatgattt aaataataat
108901 ttattatatg aagatttgac aatgaataaa attatgggta tactagaaat gaataatcat
108961 aaaacattaa gagataaact aagaaataca gatgactttg ttgaatacag aggatataaa
109021 tttaaaaata ataattaaaa cctaccacag aaatgatata tgatatagtc tactcaatag
109081 tgagagctat tgtgttacct aaacagtaac agattgtaaa ctaaaaagct tacaaattat
109141 agaatttaca aaacttacct gcacacacat cagatgtaaa taagtttgat tacaaacatc
109201 caattaaacg ttcatttgtt tctagatttg aaaatggagt actgctaggg tccgactata
109261 gcgcccctaga gatgcgtatt atcggattat ttactaaaga ccctgatatg ctacaatcat
109321 tcttaaatgg ggaagatatc cataaggcta ctgcaagtat tgtttacaat aaaccagtag
109381 aagaagtaac taaagaagaa cgacaagcaa ctaaagcagt taacttcgga ttagcctttg
109441 gtgaatcacc cttctcattt gcaggtaaaa ataatatgga agtaagtgaa gcagaagaaa
109501 tatttgaaaa gtatttccaa acaaaaccaa gtgtaaaaac ttctattgac aatgtacatg
109561 agtttgtgca acaatatggt tatgttgata caatgcacgg acatagaaga tttatccgtt
109621 cagcccaatc aacagataaa aagataaaaa atgaaggtct aagacagtca tttaacacta
109681 tcatccaagg ttcaggtagt ttcttaacaa acatgtctt aacttactta gatgatttta
109741 ttcaatctcg taatttaaaa tcaaaagtta ttgccacagt acatgatagt atcttaattg
109801 attgtcctcc tgaagaagct aaaattatgg ctaaagtgac aattcatatt atggaaaact
109861 taccattga tttcttaaaa gcagaaattg atggaaaaga agtacaatat cctattgaag
109921 ccgatatgga aattgggtta aactataatg atatggttga atatgatgag gaagaaatag
109981 atacatttaa ttcttaccaa ggttatatta gtatatgat gaatttcag accttagaag
110041 attataaaga gtcaggtaaa ctaacagatg aacaatttga aaaggctact aatgttgtta
110101 aaagtgaaaa acatattta caagaaattt aataaaagta ttgacaatat agttaactta
110161 tgttatacta tataagtaat aaatataagg aggaaaaaga gtgaatacag gggagattag
110221 attaatcgt tctatggatg aatggattat aacaagcatg taccaggatg agctaggtgg
110281 gatgaatatt gttgttacat tctataatag agaagaaaat aaacatggtt ctacagttt
110341 accaacagag tcatctactg gagaagtaac agaggaattg gcaagtcttg aagaagaata
110401 tcctttagct ttaccttta gtagtatctc agttaatatt taaaaggagg aactgataaa
110461 tggaaataca cattgattcc ctagattta caaactttac tattaaagat agaaatggga
110521 actcacaaga gtttgatatt acagatgagt taagaattac agagtataca atacaagagg
110581 attttatgca acaatcagct aaatatgctt tttgggcttc tatattagag aaggtaagag
```

```
110641 catattctga aatggaacaa agaaacctag aaacaattgg tagtaagcta aaccttacaa
110701 ttagacaaga gtacgaacaa caaggtaaaa agcctactaa agatatgatt gaatctagtg
110761 tttatattca cgattcttat caacaacaac ttaaagttgt tgaggcttgg aattataaag
110821 ttaaacaact tcaatatgtt gtaaaagctt ttgagacaag aagagatatg atgattcaat
110881 taggtgcaga attacgacaa acaaatataaa atggtggaat tactaatcca ttttcacatt
110941 aaaaaataaa gtaaagaata taattgacaa atataaaaaa ctatgttata ataaataagt
111001 aaattaatta aaaggagaaa agataattat ggatttcaat caatttatta acaatgaggc
111061 aagcaaatta gaaagcaata acagttcttt taacaataat gtagagagct acaaacctaa
111121 aaaccctgta ctacgtttag gtaatattaa agatgcaaac ggaaataagg ttgttaaaga
111181 aaatgctttt gtacgagtat tacctcctgc acaaggaaca aatgttttct ttaaagaatt
111241 tagaacaaca ggtattaact attctaagaa agatggttct cagggattca cagggttaac
111301 attacctgca gaagagggtt catctgtcct tgacccatac attcaggatt ggataacaaa
111361 tggtgttcag ttcagtagat tcctaataa accaggagta cgctattaca ttcatgttat
111421 tgaatacttt aataacaatg gtcaaattca accaaaaacg gatgctcaag gaaatgtaat
111481 gattcaacct atggaattat ctaatacagg atataaagaa ttattagcta acttaaaaga
111541 cactatgtta aaaccatcac ctaatgcacc tcatagcttt atctcagcaa ctgaagcatt
111601 cctagttaat attgttaaag ctaagaaagg tgaaatgtca tggaaagtaa gtgtttatcc
111661 taatgcccct ttaggtgcgt tacctcaagg ttgggaacaa caattatctg acttagacca
111721 attagcaaaa ccaacagaag aacaaaatcc taattttgtt aacttcttaa tcaataacgt
111781 taataacaca gagttaagtc atgataactt taaatttaac cgtgaaacaa atgtcttagg
111841 tgaagaacct tcagagccta aacaagcacc cacacaacaa gatgtagata gtcaaatgcc
111901 aagtaatatg ggaggacaac ctaatcagcc tcagcaaggt caagtaggtc agtatgcaca
111961 acaaggtcaa agtaatggtc aaggacagca gttacaaggt acacaacaac ctatcaataa
112021 cactcaattt ggtcaaggaa ctccttcagg acaacaacca agtaacacag gttctgttga
112081 ttgggataac ttagcgcaac aacaatcaca acctgattca aacccattca atgatttga
112141 tgttagcagt gttgatgatt cacaggtacc ttttgagaca caacctcaaa atacacaaca
112201 agcacctgaa ccacaacaaa ctacacaaga gcctccaaaa caaaacaaa cgcaaagtat
112261 tgacgatgta ttaggtggtc tagacttaga taacctataa gatatagagt gccttagagc
112321 actctttat ttgagatata attactagga ggatattaaa tggcaagagc aaaaaaaggt
112381 aaagaagtcg atttaacaga tttaaataca attgatttag gtaaagaatt aggattaaca
112441 ttgctatcag atacaaacag agcagatatt aaaaacgtta tacctacaat ggttcctcag
112501 tatgactata ttttaggtgg aggtattcca ttaggtcggt taacagaagt ttacggttta
112561 actggcagtg gtaaatctac ttttgcagtt cacttatctc gaattgcaac acaattaggt
112621 gttatcacta tttggattga tattgaagga acagcagata acaatcgtat ggagcaactt
112681 ggtgtagatg tttcaaaact attctctatt caatcaggag aaggtagact taaaaataca
112741 gtagaattat ctgtagagca agtaggtaaa gaattagagt actggattga cactttcaat
112801 gaaaagattc cgggagtacc tattgtattt atttgggact cattagggcc tacaagaact
112861 cagaaagaga ttgatggcgg tattgatgag aagcaaatgg gtcttaaggc atcagctacc
112921 caaaaagtaa ttaatgcagt aacacctaaa ctaaatgata caaacacagg gttaattgtt
112981 attaaccaag cccgtgatga tatgaatgca ggtatgtatg gtgaccctat taaatctaca
113041 ggtggtagag cttttgaaca tagtgctagt ttacgtatta aggttcataa agcatctcag
113101 ttaaaacaga aaagtgagtt aactggtaaa gatgaatacc atggtcacat tatgcgtatt
113161 gaaactaaga aatctaaact atcacgacca gggcaaaaag ctgaagcaga cttactatct
113221 gattatatgg taggtaaaga agatgaccct atcttattaa atggtatcga cttagaacat
113281 actgtatata aagaagcagt tgaaagaggt ttaattacca aaggagcatg gagaaactat
113341 gttacattga atggtgaaga aattaaaactt agagatgctg aatgggttcc tgtacttaaa
113401 gataataaag agttatatct agaattgttt agtagagttt atggagaaca cttccctaat
113461 ggttactcac cattacttaa taacaaagta atcgtaactc aattagaaga gtatcaagct
113521 cttgaaaact actataaaga atgggctaca gataataaac aagaggaaca agaggaagaa
113581 ctaaaaggag aatctcaaga aaaggattct gaataatag tggataattt aatagataaa
113641 aacatgaatc aggtaaaaga atctttgggg aatgcaaatt cctcagatgt tcttcctta
113701 ccttataaag atatagcaaa gaatttgaa gaagtaaaag aaaaggtga atcaattatc
113761 attgaagaag gtggattccc ttatacagat tctacagtga tgtatataga acatgtaaca
113821 gatgatggg caggaggata ttccttaatt agacatgaag gtgaagaagt taagtacct
113881 aagactatcc atttctctga tatatatgtt aaagataaat cacacaaagt aagaataatc
113941 ttcgagggg ctaatcctta tgaagaaagc taataatggt aatagatatg taatagatat
```

```
114001 agatggtata cctgttgatt ttgaaaggga tttagatagt ttacttaata ggtataaaaa
114061 ccttagatgg tcgttatatc ataggtacgc agggatttta tctaatgatt ttgaaagaca
114121 agaactaaga gaatatattg atgagcaatt tattaaatta gttaaagaat ataatattag
114181 aagtaaagtg gattttcctg gatatatatt aagctaaacta actttaagag ttcaaaatag
114241 ttatgttaag aagaatgaaa aatataaacg tactgaaatt atcggtaaaa aagattatac
114301 agtagagtct ttaacagaag atttaaatga agacttcgag gataatcaaa ttatgagtta
114361 tgtatttgat gatatagaat ttacagaggt tcaaagtgag ttacttaaag aattacttat
114421 taaccctgaa agagaagatg atgcctttat cgtttctcaa gtagcggaaa agtttgatat
114481 gaaaagaaaa gaagtagcaa gtgagttgac agaactcaga gactatgtta gatttaaaat
114541 aaatgcatac catgagtact atgctaagaa agaattaaat aaccatagag ttaatactga
114601 aaatcatatt tgggaaaact agttacagtg ccttccttgt gttatattat tatcgagaat
114661 tcaataataa agcataggga aggctttttt ctatgtctta tagaatgctt taaaatagat
114721 tactaaaata aagattggag attaagctta tggctaaaaa gaatgttaat gatgtattac
114781 aacaagaatc tgttacagta gcagataagt atttacaagt taaagttaac cgtgacggtt
114841 atactcgtac acatgaagga caatatgcgt acaaagtagt ttcagaggga gaagaattat
114901 tcttataccc tgtacaaaca gatggtaaag gtacattaaa tgtaatgaag aaatcaccta
114961 ttgcttacac tgatggagac aatatccatt tcgtagtaaa cacagtagta gacccttata
115021 atcactcatt tatccgtact gaagatatta aaggattaga taaaggtaaa caacttattc
115081 aagctttctt agcttttcgtt gaagaccgtt tcaaatttgg tgtttataac gtatttgttg
115141 caaacaacaa agaggatgta ttatctattg tagaccctac agataatgat gcagatgaag
115201 ttaaagatag tttagagcac gcacatgaag atgtaattgc ggatttccct gctagccctg
115261 ctcgtaagga cgttaaaggc gtagattcag gagaaggtca aggagacact tcagaaccat
115321 cagcacctaa gaacgttcaa gttactccta aggaagacgg agcagacgta tcagcagaat
115381 aatatataga taaggatggt aaatttggct aagttaaatt tatacaaagg taatgagtta
115441 ctaaacagcg tagaaaaaac agaaggaaaa tcaacaatca cgattgagaa tttagatgct
115501 aatacggatt amcctaaagg tacttttaaa gtatcattct caaatgattc aggagagtca
115561 gagaaggtcg atgttcctca gtttaagaca aaagcaatta aagttatttc agttaccctt
115621 gacgttgata gtttagacct tacagttgga gatactcacc aactatcaac aactatcacg
115681 cctagtgaag catctaacaa aaatgtgtca tttgaatcag acaaatcagg tgttgctagc
115741 gtaacatcag aaggcttaat tgaagcagtt agtgcaggaa cagctaatgt tactgtaact
115801 actgaagatg gtagtcacac tgatattgtt gctgtaacag ttaaggaacc tattcctgaa
115861 gcacctgcag acgtaacagt tgaacctggt gaaaatagcg cagatattac tgtataggag
115921 gacaataaag aatggaaaag acattaaaag tttatagtaa tggtgaagtt gtgggctctc
115981 aagtagctaa taacgatgga gctactacag tatctattac aggcttagaa gccggaaaaa
116041 cttatgctaa aggagatttt aaagtagcat ttgctaatga ttcaggtgaa tcagaaaaag
116101 tagatgttcc tgaatttaca actaaaactc ctactgaaga accttcagga gacgcataat
116161 aattaagacc aactaaaaag ttggtctttt tttattgaca atttataata tctatgatac
116221 actatataag aattaagaaa aggaggggaa agtaatggat attccaacaa tattatttag
116281 aaatccatat gattatacga aagtaaaaaa attaatggaa aacaaagagc agtatatgt
116341 agtaaagttt gattctgttt ctgttcataa tttaaatgtt caaggtatga tgaatgtcat
116401 ccaagattac ctacacatct atggttacag agttaaagag tacggacaag aaaattcttc
116461 taaagatgat gaaagagacg ttaaaggcta cttatatgaa agagtaggtg agtagggtat
116521 gggaattata gtaaactcca accatattca atcagacact ttatatgagt atgatagctt
116581 ttttgatatt gagaaagtag atacatttga agaaggattg cttcaatac aggatgagcc
116641 aactgtttta gcaggattca tctatgatga tatcacattt aataaggtca ttaattctaa
116701 ttcagatatt gatgattata ttaagaataa tgatatttat tatgtctctg atataggatt
116761 acttcctgat actttatca ctgttgattc tgatagaaaa tattattcat tattacaaca
116821 gataactgag ttaagtaaag accctttcc taaatgggta gaggatgatg caaaaggttt
116881 aactaagtat tataactttc aagattttga agatgtattt gatttaaata gttttacaa
116941 aaaagaagtt gacatggtaa gagaaaagtg ctataaataat ggtaatgtat atttattata
117001 tgaggttctg cctgattata aattacctct agcttatagt ttactttcaa acaaggagca
117061 tggtattgtt attatcggtt cacagacacg ttctaataat gatatactga ctttttatgt
117121 taaaggtatg gatgctaagg caatagctag tatgttcaat gtagaacatg attatgattc
117181 taatattttc catacatttg taaacagtca cattaatatt ttaggaaatc aaataactaa
117241 gtttataaga gagaaaggaa gcagttatga gtaactataa aacaatagaa gaagtacaag
117301 cagttattat tgggggtatta tttaaagatg aaggtaaaat tgtaacatct aagtttaata
```

```
117361 aaattactaa agagtttggt ttagatagaa tcggtaaaga tgaccttaaa gaaattgtag
117421 aggatattag acaagacgct tatctaaatg aacttaaaaa caaagcaatt aaaggtaaag
117481 taacgttagg tgatttaaaa gatgttgcag ataaccaagt attcgaaggt aataactacc
117541 atgaagaagt atctacttat gtagtagcta aagaaaaaga attgtctcac ttaagagaac
117601 agcgtaagca caataggcat actgcatacc ctcaaattat gtttgatgaa cttaaagaac
117661 atatggttaa ggaattacaa ggggaaacat tagtagaaca tcacggaagt aaagctaata
117721 ttaatgatac agagctaatt gtgttactat cagatttcca tattggaagt attgtatctg
117781 atatgactaa tggtaaatat gatttgaag ttcttaaatc aagattaaat catttatta
117841 atacaacagt taaagaaatt gaagataggg aaatttctaa tgtaactgtt tactttgttg
117901 gggacttagt agaacatatt aatatgagag atgttaacca agcatttgaa acagagttta
117961 ctttagcaga acaaatctct aaaggtactc gattacttat tgatatccta aatgtactat
118021 ctaatgtagt ttcaggagaa ctaagatttg gtattattgg tggtaaccat gaccgtatgc
118081 aaggtaacaa gaatcagaag atttataatg ataacattgc ttatgtagtg ttagattctt
118141 tattgttatt ccaagaacaa gggctattaa atggtgtaga tattattgat aatcgtgaag
118201 atatttatac tattagagat accttggcg gtaaatctat tatcattaac cacggagatg
118261 ggttaaaagg taaggtaat catatcaata aatttatctt agatagtcat attgacttat
118321 taattacagg tcatgtacat catttctcag taaaacaaga agatttaat agaatgcaca
118381 tcgtagcttc atctccgatg ggatataata actatgctaa agagtacat ttatcaaaaa
118441 ctaaaccttc acagcagtta ttatttgtaa ataaggaaaa taaagatatt gatattaaaa
118501 cagtattttt agattaagga tggttaataa atggatacaa tttttattat aggtgtagcg
118561 tttataactt ttgcaacatt taacatagtc tttagattat ttgatttatg gactacagag
118621 aaaaaatgg taagtcaagg acaacctcca ctaagtaact ttgagtacta tcatgtgata
118681 gtaccttact tagtaggtgt tattgttatt atactgagta ttattttag ggattccttg
118741 tattccgcac aatcagggtt cggtgttatt attacaagct ttatttacat gctagtttat
118801 gttataattg gtcttgtagg gtcattgta cttacaatat tccaagctag aaaagctaga
118861 cagtatcaaa cacaggagga taataatgaa gttcaatgat atttatgagc aattaattaa
118921 aaatgataca gtacaaaaca ttcatgagtc tcaagatgac aaaggaaata tttatacaat
118981 acagtttgat aaaggtaatg ataagtatt attaatgtt attaatgatg gattcttgaa
119041 agaaatgaca aatggtatgg tagaccatcc tgaaggtcag ccatattcag taagtttaat
119101 caataaagaa cacctagta tgtcagtgaa acaatatta acagatgtag aagatattgt
119161 acctactatt agaaaaatgg aaaaggattt cttatagagt caagtcttta cttgactctt
119221 tttactatat atggtatatt aatatagagg tgacttaaaa atggattta attttagtgc
119281 ttttgataat agctcattag caatgagaat tagtgagggt gtatactatt tcaatgatac
119341 gccttattac tttattgagc atgtagaaga agaaatgtct gagtatgtta ttgtatatga
119401 catacatgac agagaggaaa aagaaaatcc tcagaagaaa tatagaatag aaccttacca
119461 acgtacaata ccggaggaa cacctcttag taatttaatt aagagtatga tgcctcaacg
119521 taagtatcct aagaaggtta cagaagaccc tatatttgta gctaatgtta ttcctttagg
119581 aacagataca gtacacaggta aaaccggtaa aggatttttt gaaagagata aggatagaac
119641 tatctattct caaaaggaac caactaaagt cgttcatggt caatacacag gtgttttat
119701 aggtctaaca agtgttaagt ggaatagaac atataccccc ttagaaagtg ttgttgagta
119761 ctacaaaagg gttaaaggag ataggttaaa tgtctaatga tgtagttaag ttctatgaaa
119821 aagatattaa agaccttatc agaactaaaa aacacatgtt caaagacgat gaaataacta
119881 gtgatataaa cgatatacga atcttcaatg agaaagtcat ttgtcaaggt aaatgtagaa
119941 cagattgttt agtgttagac cgtaatggta cagtaatggg tatagagata aaaacagaac
120001 gagactctac acaaagatta aataaccaat taaaatatta tagtctagta tgtaagtatg
120061 tatatgtaat gtgccatgac aaacatgtac ctaaagtaga acaaatactt aaaaggtaca
120121 aacataatca tgtaggtata atgagttaca ttagttttaa aggcaaacct gttgtaggta
120181 aatcaaaaga tgctacacca tcaccacata gaagcccta tcatacaatg aatatatat
120241 ggaagacaaa cttaatgaca atacttagat tgattagaga ccctcatacg tatagaacag
120301 ggtatagcta taatgctagt ggtagatata gtggaggga aggtaatttc tcccaaacaa
120361 ctcaaagtaa aagaatgaaa aaacctgcta ttattaacca aataattcat tatgtagggg
120421 tagataatac ttataaactc tttacaagag gtgttatcta tggttataat aataggtggg
120481 aagttataga agaagatttc tttaatacta tgaagaatgg ggtaagagta attaatgagc
120541 aaagacaaac caaatagacg taaagagata cagcatcaac ctgttaactt tgccccctacg
120601 aatactttaa caggagctaa taatagtttc tttgctaaaa agccttcaga gcctaaagat
120661 gcaacatctg ttattgaata tcgtatacta tttattaaaa gatttgataa cgtaacaagt
```

Figure 16 (contd.)

120721 acagatgtga aattacagaa aaagtatgca ctaaatctta ttagtgaagc acttgatgtt
120781 aaagaaactt acttgtctct taagcaaaaa ggaaaaaaaa cagaatctat tttgcataca
120841 gatagagttt attatgttca tagaggtaaa aaacttattg gaaagtgtag tatcagagaa
120901 caaagaacat ttaagggtaa acatttgata tttatattca aaacaagaca tagagttaaa
120961 gcagaaagga aagataaata atgttaaaag gattttcaga acatgtagac aaacctacaa
121021 ctattaagac cttatacaag accttaacaa gtggtaaagt agaattacta ggtgtatctt
121081 acgatagtga ttacttccct tcaggtgtta cagtacaatc ttacattgag gatataggta
121141 atgaagatga gggtctacag tttgttaata aggtaaatgt agtagaatca atgaaacagg
121201 ctgtagtagg tatgaataat caattaggtt cttcaggtct tggctatgtg agaactgaac
121261 aacttaaaaa agagttggaa gagactggac taatgacaga tttacttgct agaggtacta
121321 acttaacctc tactaagaaa gtagatattg taagtacttt tattgagcct gaggtaacat
121381 accaaaatat tactatagct aaagatatta aactacgttt gtataaagta gaagaagaat
121441 caccattaaa tggttacact catattgtat acttacttac tacagaaaaa ctatatgatg
121501 gtcaaacact cttcggtatg ctctctaaaa aagataagtt atctaaagga gatactgata
121561 aattattagc attcttcaga aacaatagtt taataagtaa aagtgtattt tgtgttaagt
121621 tattaagtaa agactactac tttaatttat ataatacaca tgagacaggg atattctttt
121681 tagaagacac agatgttatt actattgctt gtggtcagtc atatgttaaa gttaacacta
121741 aagatattaa gtctagttat gttaaaattg aagataagac tcataaatta actgagctag
121801 taattaacct aaagggtgac gacacattaa ctattttatt ctaggaaaat gttataaata
121861 tgtgataatt aagtataaat atacgttata taagaagttt tcataatgtt tttaatacag
121921 aaactagtta agtttttct acttgctcta gtttctgtga aattatattt atgaaaagtt
121981 aaaatatctt ttaggtaaag gctttgtaaa tagttaaaaa atatattaaa attttataca
122041 aagtagttaa taaaattata ttacatttat atattatgaa ataataacag aaattgtgat
122101 atattatata gtgtaacctt gaaacagttg atgttgtagg gtttgtttat gttcgttaaa
122161 ctggtttcag aacatcagtt accataaata aatgacagtt aaggagagct atataatggc
122221 tagaaaaaag aatttaagaa ataaaaacag tgatataaaa gttgttcctg ataaagaaaa
122281 agaaagtata ttatctaagt tataccataa taagttacta cgttcaaagg tagataatgc
122341 attagatgaa gatatgagtt atgatgatat tatagaatta tgtaaagaat atgatttaga
122401 attgtctaaa tcagctatta caagatataa aagtaaaaga aagaagcta ttgaaaatgg
122461 ttgggattta ggagaattaa ttgataaacg taaaaaaaca agtgtaaaag atattaagga
122521 aaaagaaact cctatattag aagaggagca acttctcca ttcgaacaat caaaacatca
122581 cacacaaaca atttatgatg atattcaagt actagatatg attattcta aaggtgcaaa
122641 aggattagag tttgtggaaa ctttagaccc tgctttaatg atacgtgcaa tggaaactaa
122701 agataagatt accggaaatc aattaaaagg tatgtcattt attggactta gagaattaca
122761 attaaaacaa acagctcaag atacagctat gagtgaagta ttattagaat ttataccga
122821 agagaaacat gaagaggtat tacaacgatt agaagaacta caaaatgaat tctacaaaaa
122881 tctagattta gatgaggaaa gtagaaaatt aaaagaagct ctagatagag taggctatac
122941 aatttagata gtgaggttag agtaatggca gatgagatta gtttaaatcc aatacaagat
123001 gctaagccaa ttgacgatat agtagatatc atgacatact taaaaaacgg gaaagtactg
123061 agagttaaac aagacaacca aggagatatc cttgttagaa tgagtccagg gaaacacaaa
123121 ttactgaag tatctagaga cttagataaa gaatcattct actataaaag gcattgggtt
123181 ctctataatg tatctgttaa ctctcttata acatttgatg tttatctaga tgaagaatat
123241 tcagaaacaa ctaaggttaa gtatcctaaa gatactattg tagaatatac aagagaagac
123301 caagaaaaag atgttgctat gattaaagaa atacttacag ataataatgg taattatttc
123361 tatgcactta taggggaaac aatgctctctt gatgaaaata aattaaataa agttaaagat
123421 tagggttgac agctcctata gtttatgata tagtatatgt atactaaaag taaaggagct
123481 aacaattatg tttatttcat taaatcaaga agagaaagaa ttattaacta aagaggaaag
123541 taaatacaca ccattagaaa catcaagaga gtttaacaca cctaaagaag aattcattgt
123601 aacaagctat aatgaaggta aaccttaga ttacattgca aaagaagcta aggtaagtat
123661 gggattaatt tacacagttc taaactacta taagtaggt aagcgtaata agaaatcacc
123721 tgtagaagaa agaattgcac atatcttaaa agataaaaac ttagtcaaag agattattaa
123781 ggattaccaa tatatgaatt tacaggacat ttatagtaaa tataatcttc ataagaatgg
123841 tttatattac atcttagatt tataccatgt ggagagaaaa tctgaactta aggacaaagc
123901 attagaagag gataatattg tcgttgagta agtaagagg ttataatatg agaaataaaa
123961 aatcatttca agagcagtta aatgacatgc gtaataaaga gaaatgggta tctgaagagg
124021 agttcactga agaagtggct cctcctgaag aacctgaagt agaagaagaa aaactatata

Figure 16 (contd.)

```
124081 ctttaaatga gttaaaagag agcttactag atgctcaagg attaaaagat gttgtagctg
124141 attttcctgc atctaaagat ttatatgaac ctaataagtt atatatctgt acaataccta
124201 aaggatatca gtctaccgaa gtacaaccag gacaatatat tggtattagt actggattat
124261 tatcagagtc agaagacttc agccatttaa gaggtcaaat gcctagaaac ttatatgaaa
124321 cttctcatgt tttaaaacct ttgatacgta ttaataatac aaatattgaa taccaacaac
124381 atgagttact tgaagacatt aaggatgaca aaaagatata tgatgtagag ttagaagact
124441 taagattagc aacaggagaa gaagtttctc atttagaaat tgttgataat aagttttttg
124501 aaagtcgtat taatgaagtt cttgaccgat acactgaact aacggattcc aatgatttac
124561 ttaagtacta tagtaaatta cgagaattag taggtagtga caaaatgatt tattgttcac
124621 tcctcgataa atgtgttaaa attatagatt aatagtagtc tcctcttata ttataattgt
124681 aagaggggac atttttgtat agaggtgtta attatgtcaa gaaaagcaag tatattctat
124741 atactagtgg ttattgtttt ggctttctct atctcatctt attatatatc ttctttcatg
124801 tatcacgaca aagcaaaaaa tgaagtctct actgagttat cgaacacagg aaagattaaa
124861 gaagaaaaga acgtagaatt tgtcggtgac tacacattga aaaaagtgga agataataaa
124921 gcttatttta tggaaacatt acctacttac ctaccaggta gaacaggaga taacagcata
124981 gatatgaggt actacaaaac aagtagattt aaggaagggg taaatttcaa gcttattagg
125041 gtatatactg aagatggaga agataatcca atcataagt ataggttga agcagtacca
125101 accaaaaagt aataaggagg tgacttaaat gacaacatta attgtcgtca tctttattgc
125161 tatcattat tacttatgga acagtgattg agtcaagtta attcttgact ctcttttgt
125221 tttatggtat attaatatat agaaaggaga gattaactat ggaaatggca gatttagaaa
125281 gatttgatgc atttgtaaga ctaattcag atgatgagct ttcggaggaa agaatactgg
125341 agttaagcgt agacttacta aacccgatac tagaaggagg tacagcttaa aaggctaaaa
125401 aacgtattaa gagtaaattt ggtaagttag aagcaaaaaa ttttaaacga aactataaat
125461 tcttacttaa gtcgatagct caaatagacc aaaggagata ggacaatgac agaaagggaa
125521 aaattaatta aagatattga agaggctaat agagacatac agttacagtt aaaagaagta
125581 gataattata aggacagcat acgttctaaa ggaacaagaa attatatttc tacaaaggta
125641 ttagattcta ttatggttgg tttcatagtt agtttttaa tactcattat aatgcgtgta
125701 cttgaatatt ttgtaacagg taatgctgtt tactcaccttt agcgcctgc agttattatt
125761 atgtttgttt tagcactagg tacatggaaa gtaagtaaga tgaacaaaat agtatcttat
125821 agaggaacta ttaagatgta ctgggaacta agtaatgctg agcaaaaaca agctaaggta
125881 tttaagtatc ctaatgatga agtagatatt gtatcaaaac ataacttaag acaaataact
125941 tttagtgaga ttaatatact tcatcttaaa tatatgagat ataataaggc agtagaacaa
126001 catactaaat tatctaaaga acttttttaaa aaagataaag aaactgttga caagaacaaa
126061 taagtgtagt atagtattac taaaggagga gagatatatt ggttatacct agtattaaag
126121 cacaaaacaa attcaagaat gagttagagt attataaaca aggtcacatt agtgaaagta
126181 aaatgttaga attagctttt gattacatcc aagaattaga acaaaataac gaatacgtta
126241 ctaacttgct agaagaggag agatatggtg agtaaattta tcggagtgta cttattttaat
126301 ttactaatag ctattatttt aacttaacc ttaataggta ctattactga ctcaattgag
126361 agtactttag cccaaataat cgtagggatg ttcataatca ttactatata tggaatccta
126421 tcagcgttaa tacctattct agttcataaa gctgtatcac cgggatggag ctatactgaa
126481 tggaatgaat cctattacat cagattacct ggagaagaga actacaagta ctatagtaaa
126541 tggtatttag atttattagg agttaaagaa ttttactata agagagacaa tggagaagaa
126601 gtaaaagaaa aaaatatatc atgggctttt caagctgaag taaaaagacc tgaagatgtt
126661 aaccactgga aaaaccaatt gcttactaat agacctttaa caattttaga atataaaaaa
126721 ttaaagaaat tagataagga aagtgaaatt aggaaacaag aagatttaga agaatataaa
126781 caatacaata gtaattaaag aggtggaaag caatgataag ctcatttgat agtatactac
126841 ttgtcatata cattattata gctttgcag tagctatggc aattatctac ttagtattta
126901 aaggtatgac tattctacta gataagctaa tgatgttatt attaagtaaa actacattag
126961 atgtagaagc ttgctctatg ataatggcag tcatcagtac aattgtgttt ggaattattg
127021 tacttttaat atggctagca gtaaataata tttactata aggagttta ctatggattt
127081 taatgacttt ataaacagtg aatcggatag ggtaggtaag cctaaacaaa agaagaaggt
127141 agagaataag ctaccttctt ctactcctat tgaagataag gaaagagaat taaagagat
127201 aagaagaaa tcattatata ttgatttaag gagaaaaaga aatgactaaa gaacaaatg
127261 tactttacaa agataagtat agagattata ctatagttgt aagattagca gggaatatta
127321 ttgttactga agtagataag aaacataaaa cagcatttac acctattata ttgacaatg
127381 gtgtagaagg cgtagagctt gtaatgcgta taggttctgt agagcttaac atgacagatt
```

```
127441 tacgtgagtt cacaaaagaa gtatctacgg ctcagaaagc tttagaatat tttaataaaa
127501 aactttacat taaaggcttg acagatgaag cattttaata tatactaaaa gtataaataa
127561 aataaagaaa agaggaatga ttattatgtt attaggaatt ttatggttta tatggggatt
127621 tgtatcatac tttgtattga tgtttggaat tgagtttgg aaagatagat ggatgccagg
127681 tgttatcgga gcaggagcct tactactatt cttattttgg attatgaaat ctatccataa
127741 tgctatgaca gtagtatact tgtattagga ggttgtatag atggatatac taattattca
127801 ttataaagaa acaaataaac gggttttaaa agaaacaata caaacaatac aaaatcattt
127861 aaatgatgaa catggtttgg ttaagatgac agcaacaaaa cttagcagag agaatataga
127921 gaaaagattt aataactata atatagtcat tgcagaagat gaccctgata attcttatca
127981 ttacggtgaa gctgtagaag acgcagattt tattatagac ataccaattt catatttaga
128041 tatacatgca ggaatagaat gggatgttga taatcctgta gatatgctag ataggaatcc
128101 tgattttata gaagctgtaa ataaactaaa tgaagactta atgttataag gaggaaatag
128161 aatgctaaat gaaaaactaa aaaacctgga agatacaaaa gtatacatga ttaatagtat
128221 tgcaagttta ctaagcgcaa gtacaggaaa atcaagtaaa gtatttttg atgaagggac
128281 tattaaaatt gtaagtggtg aaacaaaagc agtagaagtc attgataact tagttcaccc
128341 tcactcagga cgtttaccta ttaaaacaac agaacgtatt gcgctaggta gattaacaga
128401 ttctttacag tttgttattt cagaaataga agtagttaaa gaccaaatta tagatgaaga
128461 aaatgaagct tacattgatt ttgtgatgga agactggaac tgggattaat gcctatggac
128521 ttattaacta ttgcttctgt tgcttttata gctgtagtca ttattgattt gattaatgat
128581 gatatgagct atatgcttac tggtactgca atcttaataa atattgggc aggatttat
128641 ggatggtttt tcttactgca agcaggaatg ttactttct tactattagc taggaaagtt
128701 aaagatgata aggagtcaat actatattcc agtgcttcat taatatgtgc actaggaatg
128761 ataataaatc ttctttcatt ttcttaaaaa taagtattga caccttgta cttttgtatt
128821 atacttagta tataacaagt acaggagatg attactatga gtaaagaaac aattagaaga
128881 caattttcaa atgcaattga gattatggca acaactaaag aatggtggaa cttccctaaa
128941 agttttgata cgaataaaga atttaaaatt aaaactttta aaaatgatac acttgtattt
129001 gaagtcagag aaggcagtag aaatttagga agctttgtag ttttacaaa cattgatttt
129061 gattatgata aactagaagg aacttcaaca caatatatga ttaattactt tgctaagaaa
129121 ttaactaaag atatgtttaa ctatcataaa ttacaattat agtaggaggt ggaaagatga
129181 gagaagagtt aaaaccttt aataggaaac aagttaatgt taagggttac ttagatgatg
129241 ttaagtattc aaagcgtaga agacataaag gtaatcaaca tgggtgtgtt aaaatcacag
129301 ttactgatgt aaagattaat ggtataccta ttgaccacgt taacattgaa gttagtatct
129361 ctttctatga aaaactaaag gagcttcaag gaaagagaat tcaattgta ggtactgttt
129421 ataagtatgt taaacatgct aggggggcgca aaggtagaat taaaggattt tataaagagg
129481 attatagcgt aacttagat aagaagttac aaaaggagga aaaataatga ttaaaagaag
129541 aaaacattta gaccactcat tacagcctga gaaaggatgg agaacagtac cttttaatgg
129601 gtattatgaa gcgcatccta cgggttaat tagaaataaa gtaacgaaaa agttaattaa
129661 aggtacacag acaagaaaga accatcctaa gtggactgct catgagattg tatacctaat
129721 taaccctaag aaaacaagtt attctaggggg agtagttatt gcacatacat tccctgaaat
129781 gattagtcaa tcacgaggag accttaagaa cggtcatgtg tgtttaaag atggtgaccg
129841 aagtaattgt catgtagaca atatgtttat tggtaaaggt aatgttaaca aaaatatcta
129901 taaattaaat gattcttatt taactagaaa agatattgaa gaggatgtta ataatttagt
129961 taatgaaaga ttattctctc aattagaatt attgattaag aaaaatgaac cggaaagaat
130021 tacacctagt aatcacttta ttaaaagaga taataatgtg ttcagtatca cagattatc
130081 taaaaactca ctagtagagt ttgagttaga aatcaagaat attaagtaag gtggttatat
130141 aaatgaatga gtggtatgct ttatgttatt ataacaaaat aggtaaaag aaaataccta
130201 gacaaattaa agctcacagg gatgtatctg tattagagga tttaaaagat agattagaag
130261 aacaaaatcc taagaagaa tacaagatta aaacaacaaa agaatttgat aaggaaagat
130321 aattaatgtt aacacctcaa caaaaggatt cattaaaaga gcaacaaaaa aaattaagta
130381 aaaagaagaa ataagtcttg acaattgagt atacataggt tatacttaag ttaacaaata
130441 aagaggaggt atgacctatg ttattcgtaa ttttatatt ggcagtactg ttgtacttg
130501 gatttatgaa tggatggaac tcagaagact agataaggag tggttgtaat gaagttagaa
130561 gataaagtgt tagagagaat tgattctctt ggaaataaag caggtaactt aagtaatcaa
130621 gtaatggagt cattagtaaa gtatcaaatt acgtacggta ttatagatat tgttgtaagt
130681 attttagtta ttgcactaac aatattttta ggtaaggttt accttaaaga atataagaag
130741 gttaaaatgg atttaaaaga aagcttattg tatgatgatt acgatgactt aagtggtatc
```

```
130801 ggatggtgtt acacaattct attaatacta ttaacgttat tctctcttta cgcaatagtt
130861 gcaggtatcc caactgatat tatgagatta attaatccgg aagtttatgc agtaaaagat
130921 ttaattgagc aagttaaagg aggaaattaa aatgaaacaa agagacttig aatttgaaga
130981 ggattttgta ttaacttatg agtgtgagga ttgtaagcat ttcgaagact ggggtcatga
131041 tgaagagcct gaagaatgta gtgaatgtgg aagtagtgat ttaatcaata atacaagtca
131101 tgaagatact gagtgtgata tgtgtcgagg gtatattgat atgtggcaag atggatatag
131161 atatatggga gataataaag agtatattga aaaagaggaa tcaggtttga tttgtgaaga
131221 ttgttatgag aaattagata tttaataagg aggaaattaa tatgaataaa gcagtagaaac
131281 aagcaagtaa tgcattaggt caaggatttt cagctatggt atggcatcaa gtattagtag
131341 ggttagggtt tatttatta ggattggtat tatctttact ggtttgggta ttagtaaaaa
131401 aattccatgt acctttaat cacccgacag ctttgtagt gtactcaatt atgttagtga
131461 gtattgttgc tagttttatt tggggcggtt tacatgtaat taaccctgag tattatgcta
131521 ttttagaact taaaggtttt ataagtagg aggaattcta tgactaaaga agagttagag
131581 caaaaagtaa aagaacttga agcagagaat aaagagctta aaaaacaaat agaacgtttt
131641 gaagacgaag gaggaaaaac aaaagatgaa cagtagagaa aagaaaattt taacactaac
131701 agtaaataat tttttaatgt tagcttaga tattgtagca cttgttaggt acaagaaagg
131761 taaaattaag caagagaatt ataacacagg tcaaatttca agaactatag ttacaacagc
131821 caactcatta ggtattcttt acctagaaga gcaagaacgt aaagaaaaaa aatctgttaa
131881 aataggtact cttgaaagtg gtactctaag agggtttaaa aataaataaa aaagtttaag
131941 aaacctattg acattaggtt tctttatta tatactaaga gtataagaaa taaggaggtt
132001 aatttatgaa tggtattatt gtatttaca aagaagaaaa taaacatatt ctaaagaagc
132061 tcttagaatt cattaacaca acatcaaaag gattaactta caccttagag ggtacattag
132121 ttgataatga tatcgtttta cttaaagata acaacatatg tgattataac ctaagacagt
132181 ttagtaagac aaatgatggc ttagttatag gtctattgag tgaatcatat aatgatgttc
132241 attactatga aaaaggagat gcctacggta tagaaagatt aactatgtat ttagaggaga
132301 tgagtcaata atggtaattg cattttttat tttaggtcta ttattagtat tatgtttagt
132361 tggtcttgct attattaaag tactagaagc aaggctaaag aaaaaagaac taaggagaga
132421 aagagaatct tttggtattc ctgaaccagg gagaaaatta gggcacatag gatatgtcga
132481 aagtaaatat gctttaattc ataagaatc aagtaagata ataataagcg cagagaaaag
132541 taaagttgta gaaacattac agaaaatgta taatttagag ttaacatctg tagatgtttc
132601 tagtgtaacg ggactctctc ccttaggtac aggacgtatg gagaatatgg tattgctttc
132661 atacaaacta gaaagagaat gactttataa attaattgaa cttaataagg agtgatacaa
132721 tggaatttat agataaaaat aatgtaatta aagcttatga tataccgaat gtttacttaa
132781 aaggttacgt attgtatgca tgtgataaaa atggagacat tacaacctat gatgggtatg
132841 accaaataca ctataaagat ggtagagtat taacattccc ttttgataag ccgttaagaa
132901 agataaatgt acttcagga tattacaaac tatttaagaa ggaggacata ctatgattta
132961 ttttgttagt gatttacatt ttggtcatga taatattaga gaatttgaag cacctacaag
133021 aagtcattgg aattcagtag aagaaatgac tgaaggtttg attgaactat ggaataacac
133081 aattacaaat aatgatatig tttataatat cggagacttc ttctttaata tgaaaccatc
133141 taaagtagaa gaaatactta atagactaaa ttacaaagag atgacattga ttgcaggtaa
133201 tcatgaccat aaaaagcttg ttaagctata tgaacgtaat ggtatcacag tgaagtatgc
133261 tgatatgctt aagaaggaag gtaaaagatt ttatctgagt cactacccta cacttattgg
133321 aagaaagaat atgtttaata ttcatggtca tatacattca caactaatgg atactgatta
133381 ccacattaat gtaggttatg atgtagaagg aaagattgca tatagttttg atgatatct
133441 aagtatagca ggtgagtata gtggagaaat tcaaaggtaa agacttatat aagactagaa
133501 ttagaaaaca aacaattaaa aatttaatta ttaaagtaga gaaattacat aataaacata
133561 gcccttatca acctattggt catgtttatt attaccctaa aacaaaagag tttactttat
133621 ctaaacccga gcaaaagata tttatagagt atatgaaaga attaggtttt aatgtaaaac
133681 acaagagacg taagaaaaca cttattattt ataagaatgc attcactgaa tacattagta
133741 ggtatcatga agcaatagag cagattgaag gagggaaata atggaatatt tatttttatt
133801 tataggtatt ggcatgataa tttgggggttt catagcacct tatctgtcat ttgtagttta
133861 ctataaacat gtaagagaaa atcataatgg atcagtgat gaggaatctc tagaagaggc
133921 tatagtattt ggtatgggat tcatgtttat agcatttatt cctataggta tactagttgt
133981 aattgaagaa attaagaatt tatcttta aatgttgaca gctacaatat agtgtgttac
134041 agtatagaaa aggaggttaa ttaatgaagc attttatttt aattttagga attgtaatac
134101 tagttattgc attaggtatt gttttaccgg catggatttt acagttagta ctatctgcat
```

Figure 16 (contd.)

```
134161 tcggagttaa agtaagtatt tgggtatgta tcggaatatt tatttaatc agtgcaatag
134221 gaagtatgtt tagcagaaat taaaggagga actataaatg gcaaaatatg aatcaaatat
134281 taatggagag aattatattg caacaccgtc acaagcttta agagaggcac tagcaaaatt
134341 aataactgaa gaaaagagct ttgcggagta ccaaactaaa ggtgaggagc agtatgaatc
134401 acagttacaa ctaagacact ttgatacaat gatatctcag tatgaggaag ctattagagt
134461 actagaagat aaatatagac ctcagatttt tattccgaaa gataataagg aggaaaatta
134521 attatgaaag cagaatcaat agcaagattt tttaatgaca aagtactaca aatagagggt
134581 tataaagtaa gattcttaca ggctagttca tcgtatattt tagatataga tactatagat
134641 gaatcagtat tgttttaga agctcaagta tctacacttt caggtaaaca tttattagat
134701 acagctatta caattgagag acctgaaaca ttaagtgcta aagagctata tacagaaatt
134761 agtaataaac tacaagctat tgtaggagac caaactaaaa caactataga actatcaaga
134821 tatttaagg aggaaaaata agtgtctaat aaaaccatta caaattattt attaaattta
134881 gaaggaataa aaggagaaac gtatagtatt attgctcata tcaataaaca aactggttgg
134941 ggtgataaag gggattattt tgaaataagc ataagttata aagctgataa agaccctaga
135001 acaacgagat atattacaac tgaaatttt gttgattatg gtagtaataa tccaaaagaa
135061 attttattac aattaagaga taagattttt tctattgtag aagaacaggt agagactgac
135121 aatgattta ttgaatctat taagaaatt aattcaacta aagaattaga aaaactaaag
135181 ccttatatca ataatgaata ttattcaatg tttaaatctt ctattgaaaa ggaaatacct
135241 gtagctttat cttctgaagt actcaataga tgtacaggta aaacaagcac attagcttat
135301 ttagcactag aaaaggattt acccttagta gtatcaaatg aacctatgag aaaaatgct
135361 aaaaataaat tccctcatct tagagtagct tctgctgaag attattcaaa ttatgatatt
135421 aaaggtgaaa ttgttctaat agatgaagta gatattgacc agttatatag tgctgataaa
135481 gtatctgttg atgcactttt agtgggtatc attaaaaatt aaataaattt ataaatacct
135541 gttgacagcc tgttgacagc aggtattttt tatagtatac ttagatata aagaaaaagg
135601 aggtaatata atgatacccg taatagttat acttattgga ctcatattat tttatctag
135661 cggttataag ttggtattgg gtaagtatta tgatgatgta gatttaaaaa tactatttac
135721 catatttggt gttgggattg cattactact tggaggattt atattataaa gcaggagcta
135781 ttttattta aggagaggta aatatgaatt atagagattt tattacagat tgtattagcg
135841 gtggttacaa cgtacacatc agtgttacag aaaaacgagt acacattatt tctgagatga
135901 catcagcatc ttaccctaaa aaggaaaaтta acttagatga actacaagct tatgtgtact
135961 atatgaataa ttttggaagt caaattacaa cggaggggtt ataaatggaa ttggttatta
136021 atattgtagc agtattggtt ggtatgtatg ctatttattt ctatgttaca aagtttagta
136081 ctggcttatc aggtatttta attgtttag ggatggctat tggtctttac ttctacttag
136141 actatttaaa tgtcagagaa aatgttattc gattagtttc agtaatgttc ggagctttct
136201 tatttagtat tgaaatgatt tataataaaa ttatgttcga aattaaaaaa agcaatgttc
136261 agaagactgt tagagtgtat gataagagc agtaatgatt ttaccataag agtacctaaa
136321 ttactttaag tgctctctat ggtaccttaa agtagcttag aattgaaatt aaggagatga
136381 acaattatgt atcctgaaat agatgtggaa gaattagcgt ataagctaaa aagtacaaga
136441 gagtatttag agagcattac aacaaaagaa gtagaaattt atgaaatcta tcatcttaaa
136501 acaggtaagt tagttttaa aggtgaatac attgaggtaa aagaattact gaggaaaatg
136561 tataaagaaa atttaacact tgtagatgta gatacaatgt taagcattgg taaaggattt
136621 attgatgtaa ttaagaatat atcggcagaa aatgtattcc aaataacata taaaaaggag
136681 ctatcaacaa aatgattaaa atattttcag aagtagataa agaatacaaa cctattatta
136741 ctgaaaagtt tcctaatggt gagattaatt ttaaatatga tgatttaaag tatttagtag
136801 aagaggactt aagatttgat gttttcttta atgggaaaa tgacgcagac ttaatgcatt
136861 tgtatatgtt tactaagtat ttagagcaac taggtattaa agataaagct gaatttttag
136921 agattgcata tctaccttat agcagaatgg atagagtaga agaaggacat aataatatgt
136981 tcagtcttaa atacattaca gaatttatta ataaccttaa ttataaatcg gtatgggtag
137041 cagaacctca tagccctgta acagaagaat tacttactaa ttcttttgct attgatgtta
137101 cacttaaatt attaaatcag tatattgaaa tgtccgaaga gcctgtaaca atagtactac
137161 ctgataaagg ggcatacgat agatatctat ttgatgtaga acgtatctta atggaatcta
137221 atattgaatc atattcaatt gtatatggtg agaagaaacg agattttgaa acaggtaaga
137281 ttaaaggtat taaataatt aaagataaaa atactttata tgataattgt attatactag
137341 atgacttaac aagttacggt gggacatttg tcggttgtaa aaaagccctt gacaaactta
137401 aggtaagtag tgtatcatta atattgactc atgcagaacg agcttttgca gaaggagcat
137461 tacttagctc aggatttaaa gatattattg taacagactc tatgttccct aaaaataatt
```

Figure 16 (contd.)

```
137521 gggaaaaagc tattgctaaa catagagcta gaatcaacgg aactgaatta caaataaaag
137581 atatcgaaag atatttataa aaggagaaaa ataaattatg ctaaatccaa ctttaatgtg
137641 tgactictat aaactaagtc acagagaaca ataccctgaa ggtacagaaa ttgtatatag
137701 tacactagta cctagaagta ataaatatta tgaacacagt gataatattg tagtatttgg
137761 tattcaatca cttgttaaaa aatattttat tgatatgttt aataaagagt tctttaacag
137821 acctaaagag gaagttatta atgaatacaa acgtacagtt aaatttacac taggacaaga
137881 aaatcctgat gctaaacact tagaacaatt acatgactta ggttatttac ctattgatgt
137941 aagagcttta aaagaaggta ctgttgttca tcctaacaca cctgttatga caattgaaaa
138001 tactcactca gatttctttt ggttaactaa ttacctagaa actattatta gtactcaaac
138061 atggcaagca atgactagtg ctacactagc atatgatatg cgtaaaaatgc tagataaata
138121 tgcaatggaa acagtaggta atattgaagc agtagatttc cagggtcatg actttagtat
138181 gcgtggtatg agttctttag aaacagctca attaagttca gcaggtcatg caattagttt
138241 taaaggtagt gatacagtac ctgtagtgga tttcttagaa tcatattaca atgcagacgt
138301 agagaaggaa atggttgttg cttctatccc tgctactgag cactcagtaa tgtgtgcaaa
138361 tggtaattat gaaaccatgg atgagtatga aacatataaa cgtatgttaa cagaaatata
138421 tccaacaggc attttctcta ttgtgtctga tacttgggac ttttgggggta atatgactaa
138481 aactttacct agattaaagg atattattat ggaacgtaat ggtaaagtag taatcagacc
138541 tgatagtgga gaccctgtta aaattatttg cggagaccct gatgcagaca ctgaatatga
138601 acgtaaaggt gcagtagaag tgctttggga tacatttgga ggtactgaaa ctgaaaaagg
138661 gtacaaagta tragatgaac atgtaggatt aatttatgga gactctatta actatgaacg
138721 tgctcaacaa atttgtgaag gattaaaaga aaaaggtttt gcaagtatta atgttgtatt
138781 aggtgtaggt agtttctctt accaatttaa tactcgtgat acccacgggt ttgcaatcaa
138841 agcaacgtat gctaagatta aaaatgaaga aaaacttatc tataaaaatc ctaaaacaga
138901 tagtggtaaa cgttcacata aaggtcgagt agctgtatat aaagacggtt catgggaaga
138961 taacttaacc ttacatcaat ggctaaacaa acaaaatgtt aatcaattag aaagagtatt
139021 tgaagatggt aaactttata gagaccagtc gttaagtgaa attagagaaa taattaaaaa
139081 taattaataa atatttaaac tccctattga caaagggagt tttatttat atagtagggc
139141 tatagtaaat aaaggagtga aagaaatgat ttataaaata tcaaaacata attactatag
139201 taggtttgaa tattcatctt atttacctga tgaaggattt gcatatatag attatgtaga
139261 tgtcattctt ataggtgtag ataatccaaa gaagagaaaa gttattactt taaaagcaga
139321 tgagtttaat cctagtgatt ttaaggttgg tcataaatat aatattataa aaatactatg
139381 gtttgagaaa tgggaatggt tacagccata gggaggagag gtatacaatg attatagata
139441 aattaaatgg agttaaatta gagattggcg gtcatgttgt atcatttagt gtaagtaagt
139501 ttaaaacgat taatggtgaa agacaattac ttgattacca ccatatcaaa agaggtaaac
139561 agagatattt tagaactact gaggaattct ataatgagta caaagaaata aaaccggata
139621 agaatgagat agatgaaatg tttgaatctt taggttacgt aaatactgaa ttagaagatg
139681 tagtaagaaa ccaagagaaa gtgacagaga tattaggagt tagtgaacag tatttaaacc
139741 aattgtctta taaggctata gaggaatatg tagaaaaaat agttatctta gaaattaaag
139801 aattaaaagg agagatacaa tgataaacat taatgtaact gaaaaagaaa aattagttgt
139861 aggtgattta gtaaaatcaa gagaagatgg tacatgggtt attgtagtag aagataagca
139921 agacttaaat gtagttgtgt taaatgacga gccctggtta ttttataaat caggaattaa
139981 aagagtagaa gggcaattag aagaggactt taaatttatt aaaaacagag aagagtatga
140041 tatagatgta gttaattctt cttataaata aattcacatc tacctattga cttaggtaga
140101 tacttattat ataatagtat acaaggagat gaagtatgat gaatggaaaa caaatttatg
140161 tattttaag tgaccaatac agtaaagata tactcagttt acaattaggt cttattaagg
140221 aatggtctag gagagaacta acttattcag atgatgtcgg ttcagatgca gatgttgtta
140281 tttgtactga tatagtaaga gatgatttcg taaaaaaact aagtaaaaat aatagcaatg
140341 cattatttgt atttattagt tctagttatt ggataggtta taaaggcgga gaattctttg
140401 ttgcagttca agactatgtg aaaggtatgt aagatatgaa aaaattatta atattattta
140461 cattagctag cactttacta ttagcaggat gtacaccgga taatcatgaa ggaaaagttt
140521 taggaacagg agaatataga gagccaacta cttatatcaa gtcaggaagt gttactgtac
140581 cagttattgg tgaaatgaaa tactatgtag acttagaaac agataaaggt gaagaccgtg
140641 tttatcttaa tagggaagtt tatcgtaaat ttgataaagg tgatgatttc tctaatgtag
140701 gtaaaaaagt atataaaaat gatgaattaa tatataaagg ggactaatta gtatgaaaca
140761 atttatacat gataaaaaag atagttataa tagtacaaat cgtaattttg atattcaata
140821 ttataaaggt ataccttac aacaaattga tagggggtat ggtcaagcaa gagctaggag
```

Figure 16 (contd.)

```
140881 atttacaata aataatacga accaaaatat atggatacct atgacatatt taaaacctaa
140941 tggtactctt aaaaataaca ttgatataga ttggatactt gttaaagaaa aatgtagttt
141001 aaagaaagca ggattagtaa taaaaataga aattacagga gatgtattat aatgtatata
141061 ttagaaagaa caattagagg ttttgcaggt caaacagaag atattttacc ttaaaggaga
141121 tgaattaata atggagtatg aaaaaatgat tagagaaata atggtaaact ctaaagaaat
141181 gtcactagaa gataaaaaac atttaatgag tttattgatg agtgcttatg gtgacttatc
141241 aatactagta gcttttgaag aagaaaacac agcacatatg tatgaagaaa taaaacagta
141301 tgatactaaa aagttactga aaccaagtat ggtaagtaaa gataattata tgaaataata
141361 tgtaaccaat caggaggaat aactaatgat aaatatagaa catgattata caataagaac
141421 tgtagataat agaaagtata cttactatag taaacatgaa tccccagtta ctttatataa
141481 aaatattata agtaaagatt gtattgaagt aactaaatat gggaaagata aaaaagttat
141541 tatagctact aaatatattg tatctattga acgatggtaa ttacaaggag gagtagttat
141601 gaatgctagg gaagcacgta aaaacactaa aaactataag gactctaatg tagtaactaa
141661 agagcaacac ttaacttata tctataataa gataaactac ttgattgcaa atagtagtag
141721 tcagggtaag acatatgtgg caatgaatct aagaacagat tatcctgatg agttttcttt
141781 atctaaatta aaatatctaa aagaaattaa acagcactat aaagacctag gatttaatgt
141841 gaaaacgcaa gtaagaaagg caaagtggtc agagaaaagt gtaatcaggt actactttaa
141901 cttaggctat atagacagcg tgttagtacc tattatacac attagttggt aattacaagg
141961 aggaatagtt atgttttta aaaagaagaa gttaagcaat gtagagaaac aaataagaca
142021 aaaccgtaat aaagaagaca aagaaagaaa agaacatcaa gataagttaa atacagatat
142081 gtataaaacg tatgaattag ataaaattgt agaagaacat ttaagaaaat tagacaaatat
142141 atcccttgaa ggattagaac taacttcagt gtgtttaggg acaagacttg tttattatta
142201 ttcaataggc aaggattggg ataaacaagt atatagttta aacgaattag aatatatgaa
142261 gaagaaattt aagaaactag gatttgaaac tcagataaca aacgaagata taggatttca
142321 accttatatt tatttaagat tattatggga tgcataagta attattatta gaggaggaat
142381 agttggtgtt gcacagttaa ttacggatta tcatgacgga cattaagtat tgaatattgt
142441 tgactaataa taagaagaaa atattattac tactaagtac ctttgttatg tactactatt
142501 actactacta agtacctttg ttatgtacta ctattactac tactaagtac ctttgttatg
142561 tactactatt actactacta agtacctttg ttatgtactt gtactactat tactactact
142621 aagtaccttt g
```

Non-recombinant Phage_K (127395 bp) (SEQ ID NO: 1)

```
   1 ggatttgatt attatgacaa atacaataca agcattttta caaggacaag aagcaagcac
  61 agttaaggac gtagcaactc atggagtaca aagcggagca attggcaaat taatctacac
 121 atcagacgta gtaaacttct ttgatagtta cgagcaggac attgaagcgg tcatcactga
 181 atacattgaa gaggttacag gacaacaata ttatgactta ttgaactatg agcttatgag
 241 agacctcgag aattatgcaa atgtagaatt tgaagacgaa gacgaatata ataacattca
 301 atttgaccta gcagaaaaca ttgcttctga tgaggttgaa ggatttgaag acatggacga
 361 agcagaccgg gcggaagcaa tctatgaggc tatggatgat gttgaattag aactacaaga
 421 aactgacaag gttcaatatg ttaatctagc ggttgagatt gtagctcaaa gaatggcact
 481 atagaaagca cacagagaag cttaaccgct tctctaatac aattaatcag gagatgttga
 541 agatgaatac aagacgggta aacagagcgt taaacgaagc agttagatta ttagatgaac
 601 aaatagcaga tactcaaaag actatgcagg agttgaataa acaactagag aagcaaataa
 661 aggctaagca agagctaatg gtattagttg atgttatgaa tggtgatgat gagtaatgaa
 721 cattagagag gttcacaatg tcgttaagag tgctaagagc aaactcctgc aggagcaggc
 781 tcacccaacg gataacctca tagagcagta catcaatgat gagctacaca gacgcacaca
 841 gagaagcgga acaatacaga tgaacaataa tactacttca tatagtaata gcccatatgg
 901 tagcttagaa gagcttagag aagcttatga cctatcgtca ttatctactg gtgagattaa
 961 agaactaata caaacatttg tttaaattat tttatcaaaa cgctttacaa tcttttagtt
1021 tgtatgatat aatgaactta acaaattaaa agaaaaggaa atgatgaaca tgacaaactt
1081 acaagaaaga aaacaagaat tgaaaacgtt actatttaac ttagcttag agaagaacaa
1141 agcaactgat gagacactgc ttagcgtatt agagcaagca catcaagagg taggaaatca
1201 attaagaaaa gtaagaaaag aaatagaaat tttagtagaa gaaaaagaaa gggaattttg
1261 gaatgatatc gaatttaatg gattagacta agagggaata aaatccctct tttattttta
1321 tcctattata taattttttt atattatacg ggggcagggg taaaatgcca ctcaatggg
1381 gtgggtctat ataccctat ggtctaccca ggtacttatt ttttggggaa aattatgaaa
1441 ataaatattt aaaagtcaac acctaaaata tagaacgtaa gtcaacaccc tatattaaaa
1501 gtcaacaatt tatagtacaa atagagaacc tctaaatata aagtcaacat atctaaaata
1561 agaaagaggg aaattaaatc cctcctctta ggtattatta acaacctcta atcatgtat
1621 agtaatcata tccatcccat agaaatctct tgggtctcct ttaatgaact cttgctctcc
1681 tctatggttt gtttcctctt tataaccttc ttctttaata cgtttaatta agttctcctt
1741 atctgtatat atcttatctt ctctaaaatg gaagttatct tcataaggtt cacaattatc
1801 atgttctact tggtatagtt tcattagtca ttttcctcct cttcgtaaga ccatgtacca
1861 tattctgcat tatagtgtgc tgtatctgcg ccttcatctt catattctac actataccat
1921 gcatcctcct ctgtttctgc atctatatat cttacctctt ctgtagtaat agtacgtttt
1981 acttgtatc tcttcaactg ttttactcc tttatatttt cctctagtat tgtttaat
2041 gtctgacagt ctttttggtc tagagtatcc caactctcta aattttgtaa ttggtatagt
2101 aactcattta caatttcatc gaaggcttct gcttttttat atacttcttc tagttctgtt
2161 tctgctaatt ttctatttct tttaatttgt tctgctttag ctactaagat atgggcttta
2221 ttcatttcct ctataataaa gtttttatag tttccatta ttatttatcc ctcctatttt
2281 ctatccgttg ttttatctct tctctattgc ggtggtgctc cttactcatt tcttacgtt
2341 ccttatttgt taaccttatc ctataaacaa ggtagttaat gtataagata ccggctgacc
2401 atagtagcaa gaatgatatt aaataagtcc atgagatact aatttctatc attgtgagtc
2461 ctccttatat tctttatagc tcttaatggc tatttacaa ataccctctat ttacagcaac
2521 aaatactata aatgataata gtgttataac tgctcttaca tcccctgtaa aaggtaatga
2581 ttgaaagagc aaaatagtttt ctaaaacact aatagctgta atagtagtta gatataatat
2641 agataataag taatccttta attttagttt aacaaatggt ttttgtgct cacctgttct
2701 tacaatacca taagtatta tgaaccacat aacaggtact aactgtataa taaaatcatt
2761 gtctacattt aatgcatgta gagcgtaaat aataactgca ggaataccta taatgaatgc
2821 tagaaataca taaaatataa ttaacattat aggaagggct acaagaaaac ctagaccttg
2881 ttttgaatac tctaatgtgt tttacctag gaacttaaaa aatgttttat tcatcttctt
2941 cctccttgga attactttct gtaattgtaa tttctaaacat attattgtaa taatcattct
3001 tttgattgat attatagtta tcattgtatt cattaaagtc tacataaata tattcatttg
3061 cgtcattttc ataaataata tctatagctg taatatctga atatgctgta atcatttcat
```

```
3121 aagcgttcgt attatcagga taagcaaaac caacttgagg tatttccata ggcttatcaa
3181 taagaatacc gaaataagta cagtgacgtg ttcgacttat acttgaagtc cctttatatg
3241 taccatagta atctatacct tctgtaatac ctgatatatg gaacctgctt acgtctttag
3301 gctctaatct tacaacatcg caattctcta atactaaatc aatatatttg atattcattt
3361 taactctcct tttatattaa taattttttc cattctttat caaccttttt aagttctttt
3421 ttattatagt ccccgtcttt agttactaca gtgttccatt ggaactttttg taataagcta
3481 aaattatttta taatccatat attacttttta ctataataca tattgtcttc aaatcttata
3541 tcttttttcta taaaatattt atatatttta tatcttcttt catctgcacc tgatatttta
3601 ataatttcat tagtatttaa ttgagtggat aactggaaga taacatcttt tactttcaat
3661 aggtctttaa cattacctct gcctacatgg tcattatagc aatcatattt aactttttttc
3721 ttttgttttc tatcattaac tacaatgaat atattatata cgatataagc tttaaaatgg
3781 gtataggtag taggtgcttc tgaatcatca cattcttttc ttaggtctgt acattgtatt
3841 tttaatgtaa tattatttga tatgttaact acagtagagc cctcatgttt tttattaaga
3901 tttatctttat ccatttttata attacctact tattgtagat acaatgtact cgaacatctt
3961 ccattacttt gcctaataga ttctgacctt tccagttact ttgctctaat attttagggt
4021 catttgcttt aagacctact ccccatatttt tatcataagg tgaagcttct acaaaatctt
4081 tacgtacatc tgtgtctaat attcttttgct ttaggtgtgt agtcataaat ttatctttaa
4141 ctacttctac cataatatta tatcttactt tattccactg ttcttcatta aaattacgaa
4201 ctttacgacc taaacttttta gcatggtttg ggtcttagc atttagtatt tcacctgcta
4261 tttgaaagtc attaaagtat cttgctttgc gccacataaa ggcttgctct gagttattaa
4321 atgttcttcc ttggtgttta aactttatag ggtagaaatt agaataaata tcctctttac
4381 cccaaaacat aatatatttcc cttgtttctc tcataataatt tctccttttaa ttccatagtg
4441 atggtaatac aatttttaaaa ttatctaata ttttactttg tacctgttca agctcatcat
4501 atttatccat atcaaaaatca tccatttctt tatgataata tttttattaag cttaaaatat
4561 gttttatcat atctatttgt gttctttctt tgccgtctac atctacaaaa gtatggtatt
4621 ccatatccac atgattacta ctctctataa atgcatttag gtcagcgtat agctgaataa
4681 aaaaggacat gtcataattc caatacttag gttcatttct acctagtttt ttcttcattt
4741 tcttatattt tttattcttt tttatcccaa aaacttcttt ttcaaagtca ttcaatttaa
4801 gaccttttaaa atatttttttc ttcatttctt aacctccaat ttaataaatg gaaaatcaat
4861 gttttctaaat actgcgccaa catcacacat taaacatgtct ccattaattt ctacttctcc
4921 actgtctgta ggggtgtgac cacatacata ggtaaaacca tcttttctag gttgaaagtc
4981 tcttgaccat attaattggt caattgtttg ttcttctaca ggtttccaac taaccccacc
5041 tgaatgagag aatatatact tgtcttcttt atagtacttt ctacaattaa ccataagtat
5101 tttaaatttt ctatagtcgt ctgattcttt aagtttcttt agttcacttt taataaaatc
5161 ataattattt cttagatttt ccctctacact actatatttt aaagttactg tactcacacc
5221 gtaagagtta agtgtttcta tacaatatct tgagagccat tcaatatcat agatacttaa
5281 tcggtctacg tttttccataa tattataaaa ctcatcatca tggttccctta acagagttac
5341 tacattatca tcattagaca ttaaatcaaa tatatagtta acaacatctt ttgaccttttt
5401 acctctatct acataatctc ctaaaaatac tattgtttct tcaggttttc tttcattatt
5461 tatttttatcc ataattgtta ataattttttg gtattctccg tgaatatcgg gaacaacgta
5521 tatagccatc taatctcctc cttattgtat ataactatct taccatactt agtaaaaaaa
5581 gtcaataaaa aaacacctat taaattaata ggtgtttatc atttaatgtt attttaaagt
5641 atcattacca tgtgctaatt ttttatcatc tattgcatgg tcattataaa tatatttaac
5701 ctctatatac tggtcttcac ttttcagtgc atctactata gaagcattat tagttattga
5761 gcttgttcta gggtaagtaa attttttgacc gtcagataaa ataaatgtaa catcaacttc
5821 aaagttaaca ggtagtctgt atccataatc ttccaaataa ttaataaagt tattaagaga
5881 aaatggttta tacttgccat ctaaggtata gtcaatatat tcatttaatg cattagtaag
5941 ttctgattct gttaactcca ttgtatcata atcttttttcg ttatagaata ctacaacatt
6001 aggttgttct atactagaat ctccgtcttt atacttagat ataaaaaatc caatatttcc
6061 tttatgctct aaataatctg ctttcataat tttaagtact tcttctgcta taggttttgc
6121 taatagtgtt acccattcac ctttttctgc gtcataaaca ctaggtagta cgttaccat
6181 catttaaaatc tcctcttctt aatttattgg tttaaaccac aatttactct tatcacttgg
6241 ttctgtttca ctaactacga aagagttaga atcaatgttt aaagtattaa aaacaatttc
6301 ttgtttgtct tcattacttt ttgttgtaaa ttcgggaaca tctgttaata tagactcttt
6361 accattaata gtccatgata tttaaaagaa ccctttggcta tacactgtat tcggtgtcag
6421 tttttcaatt ataattttag cggatgcacc tgtaattttt tctgaagatt ttaataattt
```

Figure 17 (contd.)

```
6481 acctttggaa tcatataagt ttaatgttct ctccacaaat tttatctcct ttactatatt
6541 ttgtacaatt aatataacaa aaaaacacct attagtttaa ataggtgtcc gacagagctc
6601 ccgtacttag attacggtta ataatatttt acgacaacta tatgagaccc tctgtcgttg
6661 aaactcttgt cactgcgtta ttccacaaga tatttttagaa ggtagcttgt ggaagaagat
6721 tgtttttaaa ggtacaatta gcgttttaa gccattcga tacccaggac actatgtccg
6781 tactaactat tacgtcaata aaggttctac ggtctcaatt acctactctt tattgttaaa
6841 actaaaatta agcttgagtg ctctagaagc caaaatcaat taattaacta tagatacgga
6901 atggagggc actaccatcc ggagtctacg gtcagataca aagcctctgc cgggcaacat
6961 acggtatctc tcgtacatca ggttgactag acctttagag tttttcactc ctctcttat
7021 aaccagtaac ttaagagaaa taggttttac ttagtagata tgaaacaata aatccacata
7081 caatattaaa tcatagtcaa gtgattgcac atatgtctaa cacctataag ttttttgcta
7141 gcctggtata tggactctgc aggattcgaa cctacagtca aaccgttatg agcggttggc
7201 tttacctta agctaagagt cctagaaata tcctgagaga ggactcgaac ctcaacgact
7261 aggtagctac atctagccaa tgccattact caggattgct agtaacgcta aatagaatta
7321 taacgttacc gtagacctt tctacgcttg gtagataggt aaaatataat gatttcaaag
7381 tacccatata gttaggctct tattctcatt ataaggttaa aaaggctaac tgtgtttagc
7441 attatataag aggctttagt taactactat actaataata taccataaat tatacttaat
7501 gtcaagttaa tttatcaatt gaatctataa tttttgatgt gctacgtata tctgcttctt
7561 tactatgttt aaggagatat tttaattca ttaaaaaaga atttttttct ttttctataa
7621 tatcttcttt atcatcatat tctgaaaaca taatgaattc tatacctata ctatttctat
7681 tatgtgaaaa catatttata gaaaaaggtg aatcaaaatt tttatcatct ttattaatac
7741 taaagtcttc agtaacctgt aagtcattta tttcagatat ttcaaagtaa ccattaactc
7801 ttttaagttc aatataacta ttgtatctaa agtaacgttg ttcttctatt aacttctctt
7861 ttgttatata aggatattca tttatgaata taggattact tgttccatag ttatctctaa
7921 tatattctgc atcctctagg gaatcagtat aacctaaaat ttcataactt gttgtataca
7981 ctgtatcttc ttcccacaag tcatagtcca tttcctctat ttcttcttct aatatataaa
8041 tttttttcat atattactcc caaaccccga taagattttt aagcttagct ataacctctt
8101 cttctgtttg ataagaaaat acccctgtaa tatgttcata gttacctaca atttcataat
8161 cttgtgtacc atgtttatct actaagtatg agttattcat aacatttaaa ctatcttctg
8221 agtaactaaa atttatgtta tagtctacta aaaaattaat aatattttc atttacataa
8281 cctctcctat cggatatttgt cctagcattc ttgttccatt ttcattataa aaagtatatt
8341 ctactacaat aatatttcatc atatctacat atatagcttc tatatacggt gtaatatttt
8401 cctcttcttg tatgtgttta cctatgatat catataataa ttctgagtgt attcgtttat
8461 ctctcattat agacctccgt aaggaattct acagttttgt cttttcaaaga ttttctact
8521 aattccatag catcttata gtgtttgata ttagattcat tagactlaag tttatcttt
8581 acttcttgaa ttagggggctc tactttatta accaaatctt tttctttc aatacttaca
8641 ttgcttctct tattgtctaa tacttctttt ggcatatatt taacttttgc aaagtcttta
8701 tagctaacat ttaagttatc taaatcatct aataaatcat tatagtattc taaatgatta
8761 tagaatgtat aaaacttaac aaggtcttta ccagttaatt ctccttttt tagtatatta
8821 ttaatattac cgataacaga atatgctata ggcttaaaat tagctctaac ataagttaaa
8881 aatataaaat catcataaaa taaatctaaa acagttttat tgaatctagt attttagct
8941 tgctctaatt gagcacataa attaagaaca ttatcaaacc cacttttag aactaaagag
9001 ataaatcttt ctactgcata gtatcttgat acttctgtat gcttacttgc ttttcatta
9061 ttcctaaata tagtatctga taaaggttga acaactaaac tcatgtaatc tttatctgaa
9121 tgctcatctg atgttccttg ataagtactt ccaaattcta ttgttgataa taagaaactt
9181 ttttctaagt tcattataac atcctccttt tatttgttat ttaaataata acatatattg
9241 ataataatgt caatacttat atatcttctt ctgtatcaac ttcatcttgt ttatacttaa
9301 agtgttcata gactttaaat agtataatcc ctagtgttat taatcctaaa atatatttca
9361 tagcaatcct ccttaataac catgtttagt tacccaccct gctaaagcat ccatagctat
9421 atcatattct tcttcatttt taattcttat aatttctctc atttcttcct ttgcttgctt
9481 agaactaata aaatcaatat cagtatcctc taggttagtt aattctaagt tttctctaat
9541 aaaattcttt tgacttggtg ttagagaatt aactcttaca ttttcgtgat ttagaaattg
9601 gtagaagtcc atattactca tcctttttaa cgtattctgc catatctttt aaaatactta
9661 gtacatactc taaatctcta tattggtcat ctaacgaacc tataatagca tatggtgtca
9721 tatcccaggc atgtgcacag tcaaacccta atactctctt accctcatag tcataatcat
9781 cgtaagtgat acctctatgg gcacgtcttt ctaaggagtc atattctttt tcattgatat
```

Figure 17 (contd.)

```
9841 ctgaaggtaa agttatatat ccatttagat gaccagtttc agggtgtctc ttaacagtta
9901 gtttaactcc tttataataa atatcaagac ttaaatcttc tcctagaata ttgttttctt
9961 tttctacttt ttccataatg tattgaggtg cttttttaaa cataattagt catctccttt
10021 ttatttatat cttactata cactattttt tatattttgt caacaaaaaa aggctactaa
10081 ttaaagtagc ctaaatatta attatttagc gttataagac caacgccaat aaccattttt
10141 ctgtgagaac tcaaagtgaa aaccatcata gtcaaattca atattatagt ctccatcttg
10201 aagtggtttt gaatttagta caggactatt actctttgcc aattctgcta gaaactcatg
10261 atttactttt tccatagggt ttattcctcc taattattct tacagtacta atatatcata
10321 ggtctttttc taagtcattt ttaaaagttt cctcgtaaga actagcgtaa gtaacctcat
10381 aacccactac gttagtatat cctacatata atgacttata attagatttt atcttaatat
10441 cttctgattg ttctagctta tttaagactt cacctaaatc atctgaagaa tagtgttcat
10501 tatctattgt tattgtttta cctggggtat agatatcaat ttcttgtatc atcatttcat
10561 cctttgatt attcattatt tgattataag tttctaaatc atcaatgtta tctgtatctg
10621 aaccttttac taaccattct cctctcttct taaggaggtc atcaaacttc tcatgctctt
10681 taattatctt ttctacctca cttggtatta acacagcccct agcatagttt atatgccaca
10741 tagacatatt atcaataaga taattaacca ttcttataat ctctttttca tttgccatat
10801 accaacctcc ttatatctat tactaatata agagaaaagc agacttatta aaagtctgct
10861 tctgtaccta attcaatct tctatttttc atatgaggaa tcatttttt atctcctgtt
10921 aatagagata attctctagc tttttcttta gataatgtta gtagtccatt ataattatct
10981 actttactat tatattgtct gactaagtac tctagttcat cttctataac tgctagttct
11041 cctgatttaa ctccaagtaa cttctatac atgtcataat cttcagaaag actttctact
11101 ttgtttttag atacagaatc ataaactgct tgtaaattac cttcttcaat aagtttaaaa
11161 ttatattcac caatgattaa ttcttttca gaagagtcaa gggtaactaa accacttgta
11221 ttacctgtaa agtcacctt ataatctaca acaattcctt cagttattt atctcctaat
11281 tcaatagttc catcttcatt ttctttaaat ttatgagcat cataaacttc tactttatca
11341 cctaatctca aatcttgagt taagttatgt ttaccaataa ttctatccat tacttaacct
11401 ctccttatt aatagggtct tgtgttaaga acattctaa gttctcttt gtaataggta
11461 accaaaaata tttactttcc ggaattgtaa ctgtatagaa gtcttcatca ttattaactt
11521 tgatgttaac atctgtaaac tcatcttgca ttaaccaatg ggttacagtt aagttatatg
11581 acccatcact aacatatcct aaatcaatat catgtctaaa agccaaatct tctaaatgtt
11641 ctaataaatc gttcttttca ttatgttttt cttcttctgt attatttta attgggttaa
11701 ttaattctgt acaaacaata tcatacaatt caccatctgt aacctcatag ttcttttcaa
11761 ttaatacatc ttgtatttta ttgattgaat ttgtaactac tttcccatat tcttcttctg
11821 taaacttaca tttatctaaa tcaacatctg taattaattc tgcaatccat ttatttaaaa
11881 ttgatactgc cattgttcga gaaataatac tatcgtatac catatttatt taatctcctt
11941 atttaggtga atgtggtctt ctaatgaaaa atcaaaaggc gctacaccat ttctttatt
12001 atttgtttct tttttaagta taacataagt tagtgaaaaa gtcaagatag ttactacaac
12061 cattgataaa agtttaatca ggttttttcat agttactcta actccttaag tttatttttt
12121 actttctctt tatcgtactt ataatcttta ctagagtttt cattttttttc tttctcttct
12181 tcattaagtt ctctatactg agcttcttct acctcttgtt cttatatatc gttatcttct
12241 tctgctttt gaattctac attcttacta ctaccattta cctttttct aaaaagaaac
12301 caaagtatta ataaaatgat gagtaaaata acaatgctca atacaacagc ccaaatatta
12361 ttagccatta caacctacct ccgaatagtt tttttacagc tcttaagttt tcagatgaat
12421 cgttattat atcaattcct acgctagaat caaaaattac agcattatca agtatatgct
12481 ctgttaattt attaccataa ctactttac ttaccacact accataacca tgattagtta
12541 ggtcaaccat atcaggttca acttctagta ctctaaaaga tattctacgt aagaatgaag
12601 gatttactaa gtaaaaggaa gatttaaaaa catttaatct ttgataagaa tgttttatat
12661 taacaacaaa ccctgttaac ttatcttcat atcctgaatt tgataactta cctaagtaaa
12721 ggtttatact atatccttt gttctaatg tttgaatagc acttaacatt atagcccctc
12781 tgtaagcaag attttcaggg tcttccatcc aactaatact agaattataa aatacatcaa
12841 taactttctt ctctgcttta actctttgct gagacatcat agaattaggt aaccctttta
12901 tagcattagg tacgtgaggt tgatacccctt ccggagctac gacaggtttt cttttactg
12961 acttatccat tctaaataat gcatctgtca ttttttttaag tttaactacc atatcatatg
13021 actctctatc accctttaacc attaagttat aggcttcttg aaaactatga gtccctgtaa
13081 aatcatagct aacctgtatct gatgaattat ctctacctga aactctattc tttttttaaag
13141 cagaaaagaa atcaggtaga ccatcatatt taattacatt taattctgag ttatctatta
```

Drawing Sheet 107 of 179

```
13201 atcgtctacc cattgatttt cctcctattc taatcctaat ttatccataa ttgtatcaaa
13261 gtccattgaa tcttttgatg tactatcaga ttttctaggt tcctgcttag gctcttgttg
13321 catacctaaa agctttcttg ttgcttctgt gtatctgtta ccctcaggta aagagctaat
13381 aaattgatta atctcatctt tcggtacaga tttaaagata atactttcta caacaaactc
13441 atcttccatt actccatcta atttactacc attaataatt gcacgcattg agaatacata
13501 aggtaatcct ttttcatcat tctcatgtct taattgttgt acaaagttaa ctaggtcttc
13561 attgcttgat aactgatgtt ccaccttagt atcatagtca aattcaactt gagcaaagcg
13621 gtctaatgta gctccgtcta attgttgtct acctacataa atatggtctg ctcctgttcc
13681 catagtatta cctgctgaca caactctgaa atcttcatga gctgttacac gtccaatagg
13741 gaagtcaaag tatttatttg caatagctga attaagaatt aatagtactt caggaataga
13801 tgcatccatt tcatctaaga agaataaccc acctttgta aatgctttat agaattgggt
13861 ttcatgaaac ttaccatttg catcaataaa tcctgttaat ttaaattctt gagtaattgc
13921 attactgaaa taaaaatcta aatctagagc ttctgctact tgttctaata catggttctt
13981 acctgaacct gctccacctt ttaaaaatac tggaatattt tggttaacta actttagtat
14041 atcttggtat ctataatgga agattcctga gatatcttta attgtttttt cctcttgtt
14101 gtaattcaat tttaactggt aaattactaa gttgttcttc tacatattct tcaatttgtt
14161 ttttaacgtc agtaataata atttctctac tctcagttcc tgcttttctca acaattgcat
14221 ctacaattgc ttgttcatac ggattagagt ttttctctcc tagtttgtct gccaagtctt
14281 ttgttgtttc catttgttgt tctaccaatc tctctaatct ttcaatagta tcttgcttg
14341 ccatatttat cattctcctt tgatttgtta tacatttatt atattacaag tatttgtatt
14401 tgtcaacaac tttctaaaac ttttttttagt tgttaataaa aaaaaatacc ttacacctat
14461 aacttaacat agggtaaggt aattgtcaac actttatta aaaatacatt aatttaaaaa
14521 aatcatcaat atctttagtt tcatgtgtat ccatatcata cataaacata caattatatg
14581 tatgattatt cattatttct aacatgttat gcatagaagt tgcattattg aattcctcta
14641 aatcaatagt taccgtaagt tcttgaccct cataaagtat gtttgctata taatatttcc
14701 taacaccttc cattgttcca tgagaagttt cattatgatt aagtacttct acacctagtg
14761 aaggtaaata ttctgaaaag taatatttac agaaatatat aaaattgtct gttcttttag
14821 acacgagtac tatctccgta ctttatattt cttctaatc gtacataata tgtttttaatt
14881 ttttgtactt ctttatctac tgcatccttt cttcctaacc ttgtagtata tttacaata
14941 ttaaatatca tagaatcaac aaagccatca taagaaaaat gttcttctag aaaagaaata
15001 acatccttac tacctttata gtgttcaggt aaatgtgcat ctacttgtat attataataa
15061 tcttctaaaa gacctatact ttcaccaaga ctagataaag cgtaacctaa atcatttgaa
15121 tcattagacc attctttaga tactgatagt gcatctctcta taattgttac ttttaattta
15181 tctaaataat cttctacttg agcttgtgtt ttcataaatt cttttgcgtt catgtaatac
15241 cctcctaaat tatataaaaa aaaacacccct gcttggctac aagcaaggtg aaaaaggaaa
15301 gatattatgg aagtgtacta tctaagtaca cctcataata taacagtttt ccttgctagt
15361 tattacttat ttttttaaggt cttcttcttt gacaaaacact ccattaataa gcttaccttt
15421 tctgtctttt atctcatcat aagccatatc aatacactct tcaatatcta tatctaactg
15481 taaacatagt actgttaata ctacaaaaat atccccaaca ctatctcttg ttacatggtc
15541 attacttta gcaataccttg aagctaattc tcctgctct tctaataact ttaacattg
15601 accttcaggt ttacctgtt gtaaatttct atcttttgcc cattgtttaa taagttctac
15661 tttttccatt attctatatc tcctttaatt tctgtatctt tgataattag gttatcagag
15721 tcacttgtta catttaaatt atcttcaact aatcatgta gattattagt aatatcttct
15781 tcatacctat aacctacacg aacataagct ttaactctga tatctatatt aacataatct
15841 tcttggaatt tttccatttc taacttcctt tattatatca tattatgata ctattgtcaa
15901 ttaatctgag tagtttcctt tagcaagttg atactttttg tgtaattctt catataattc
15961 tctcatacct tcatagtttc tcatatcatc ttccaagaaa ctaaggtaat ctaataatac
16021 ttttacatcc tcaggttcta aagttataac tggttttacc attaggcaac ctccttaaat
16081 tcttcttttat ttattttctt gatatctttt tctaatgctt ctttttaattc attaggtaat
16141 ttataggcat caaattgattg ttgttgacct aatacataac cattatctgt aatacgtatt
16201 tccactgtaa accatgaatt atctaaatct tcttctaatc ttgctaataa tattaaacaa
16261 ctattttta gaattctgtt agcataccca ccaacacaat gagataacat tttaccttca
16321 tctttaagtt tacttacagt atctgcagga aggaatttta ctttctacc atctttaat
16381 ttataagttt tatcaattat tttttctaat ttattatcat atttagcttt aagttctgca
16441 tcatctaatt gttgttgtat agattgtttc tcatctgtaa ctatatcatg ttctagtttt
16501 agtgaaaatg gtgttaaact aacactctct aatgttctat aaccttctct tattaatatt
```

```
16561 gataaatcat gtaagtaatc taagtaatag ttatctagtg catatcctgt tatacgttgt
16621 ctgtcttgag catctacatc taaatagtgc gtcatctttt tgtaattagc aaaagatata
16681 gataatattt gattcacaat aggtttaact tttaaagcat ctgtaacatc tcttgaatct
16741 ctaaccatta aaaaggtatc gtcaaacaat tggtgtaaat taacttcatt gtgtaaatga
16801 ttatagtgct tatagagaat attagcaaat cttaagtaat taccttgctc aaatttattt
16861 aaagttagta actttttata agtctgtttt gtaagattga aggcttcatg aactttccat
16921 ttaggttttt taggtatatg gaatagtaat gcatttcttt caaataaccc aaattcttct
16981 aagttattta ttttatcaat attttaaca atatctgtta aagttattaa gtaattagaa
17041 gttgaatttt ctcctataaa aatcctatat ttatctcctc tataatttat atgaccataa
17101 acatctgtat tatcaggaca ccaactagaa aaatcaaaat tatggtgctc taatgtttgt
17161 tctattatct ttattataat tcctctagtt aagttaggtt gtgcatagtt ttttaaaata
17221 acatttaata aaacagataa agttaattca ttcttatatt cacttttact aatatcatct
17281 ttatataggt ttaaagttat ttctttatta acaagactat ctgttaagaa aaccttaact
17341 tctcctgttt taacgtcaaa tgaactttta ttttctaaaa cccatttgtt acccatatta
17401 tgtttatctc taatatgttt aactttaaga ccaaaagatg aatagtttc agtacttgga
17461 tgcatgtacc aaacacggct atataattca tctgtcatag cactatagta ctcactagaa
17521 cctttttcta tatcttcatt cataacaata atagatgact ttataagacc atatttacct
17581 tggtctagta catccataat atcattattt aaactatcta ctacttttt atatttcttct
17641 aattgtctag attcattcct ccataaatgg tcattaccett ctagttcttt aatttttct
17701 tcaacataac cttttgattg tatacgtctt ctactcttat caccatatac aggaaaatct
17761 tttctttctt ctctattaga ttcaatatac tctttgtaac ttcttccttt attatcatca
17821 actacaccttt caactaattt ttcaactgtt tcataagggt taccttcaaa gtttgttact
17881 tctttattac cacataggg taaaaataaa tgtatttctg tggctgtatc aaaactaaat
17941 atattatgaa tatctctaaa taattcttta gaacctaagt taattatatt attttctttt
18001 ttcttaagaa atacatcttc ttctcctata tagatacatc ctttattaac cttaggtaaa
18061 ttaataattt cttgttctgt taatccttt tgtttataag ttattgccat ttaaaatcac
18121 tccttatttg ttatgtacta atcataccat agtaaataat atttgtcaac aaaaaagaa
18181 gaacttttta aagtccttct aaatgagttt cgtatataac ttttgaatt ttatttaatg
18241 gttctaaatc taaattcata ataagttttt tatactttct tgaatttta aaattgatag
18301 tatttggcat agcaagagct tcatcaacat ctttagtata gcttacaaca tctgaataga
18361 tatctacttc ttttacatat agaccttgag ttaaactcct aaatactacc tcattatgtg
18421 ctataacttc ttctttcttt tctatgctca tttataaacc tcctggtcta ctctacacaa
18481 acaagtacgt atctaaatt agttaaagaa actgatttaa tattgtttaa ttcttgtaat
18541 ttcttaattt ccacatcata gtcttactt atagtccata atgtctctcc tgctcttact
18601 ttgtgataat atttatttcc ctctttgata aggtcattca atattaccta cccccttgag
18661 taataattag cttgtagata acatataagt ataagaacaa agtttacaaa ttcagtagct
18721 ataatatgaa cataggtatg tgttaaaacc atacttacaa ttaatgaagc taatcctaat
18781 ccaataataa gaaatagaaa tctattttgtt ccttctgcac tttagtttt ataaaaggtt
18841 gttatctgag ttacatacgc aaggataata gtaatagttg ctacagtttg tgttaaggct
18901 gtaaagtcac ttaataaaaa tagtaacagt gagaacacaa taataaaagg tatagagaaa
18961 tagtcctttt ttctatatga agctactaat aagcaaacaa tacctaaggt taaattaaga
19021 cctacagata ctatttgaaa tactgaagca tcagttaata ataagttgta aaaacttata
19081 cctactgtag ctacaattaa ataccaaaaa tagttactaa ctcccttgac actttctgct
19141 ttaactaatg ctactaaacc tggtatatat cctactgtaa ttaatatagc atataatata
19201 cttaagtaat gtgataaaatt atccatcttg ttcccctaat ttctctaatc tattaataac
19261 ttcttcccat gaaataaaatc cttctccgtc tgttagttct aaaaccatac catacacaaa
19321 ttggttcgta ctaaattcag ctctgtcagg gtcattgtat ggtttaccat gtccttgtct
19381 aatatccgag cagtagatta atacgggttt atttacaatg ttttcaagtt tatctactat
19441 taattcttct tcagtattta atgacgtttc aaacttattt gtaaaataat taaaatactc
19501 ttctccatta tcatatatat ggttaattgt ttcttctgct tgatgtttca tacctaataa
19561 aataccgagt tctgcaattg ttcctaatcc ttcattaagg atatcaaata caaaaatatc
19621 tgattcttgc atagccttaa agtcattagt taaaatacgt tctgctagct tagtttgttc
19681 tgcattagct ttatcattta ttgacttatc tttgtgaggg ctataaggag ttactcctac
19741 aatgccatct acttctttat gttgtttatc tctgtaatct accatagctt catttaggat
19801 atgtccaccc atataaatta cttttgtcttt aattttatta cccatctata gtatctccttt
19861 tttcttctaa aatttctctt aaaatatgtg gcatttttt cttaatttgt ttatctacta
```

Figure 17 (contd.)

```
19921 ttttcagtat attttctttt tcttcttcca taatatcatc aacaaagttt tgacctactt
19981 gtttcataat tagaccgaag ttttctaatt ctaaatcatc ttcagataat ctatcttctt
20041 ctatagcccct aaaaatcatt ttttccattc ttgctcttgt aatggcataa tctgccactg
20101 actcgttctt ttttacttct gttttcattt tttgacgact aaattcttta aactcattag
20161 atactaattt aaagtagtca tcatattctg atttaccatc taagtattta attactatac
20221 cttcaccctt atcaggttta actgtcatgt cagattttcc tactaattct tgaatttctt
20281 caggttttaa atcatttaag tagtgagatg gtttagatac tagcaaagtt ttaactgttt
20341 ttaaccctaa atgatgtgca attacattca tgtcttctac tgataaataa acttcatttt
20401 ctttatcata aacatcaaat acataaaaat tgttgtaaaa ttcttctttg tactgaatct
20461 tatgtttgac taaccattca ccaaaaataa tgtatttttc taaggctgat acgtacgtat
20521 ttcttacatt tatattttca tgtacccaat cataaaaacc atttaaagtt tcattctcat
20581 ttaattttt tctacgtgaa aaacatacta attcaccatt ttctactgtg aagcttgcat
20641 tacttccatc taatttttct tgtacaacta gacctcttc tttaaattta tctagtacaa
20701 tacctttatt ttttacttta gtatacgatt tcattaatta tcctcctttg aattatgtac
20761 tatagaaaac aaaataagac ttacgcttgc taaaaatgct aatactacta aaccaggtaa
20821 atttaaaact gttgataaga ataatgatat tgcacttata acataaacta gaccgcttag
20881 aaataaagtt aataatacaa ttgttataag tttcaccaac caattgttat taataaatac
20941 cttagctaaa taattcataa aaaaatcctc cttagttatt atagaataat tataccataa
21001 ctaaggggat ttgtcaacat attattttac catttaaaat tatctgcata ttgtgcaagc
21061 ttagagcgga aattaactgt aaaattatga aatactgctc cttcataatt tttaaagtat
21121 tccatataat ctccaaaacc tgatttactt tcgttcttta aatctatttg tttaaaatta
21181 ccttctacta ttacagtaga attttttgta tgaaccttg taagaacttt tttaagttca
21241 ctacgtttaa agttctgtgc ttcatttata attatagtag catctcttag atttccacct
21301 cttaggaata gatgggatat ttgagatacc caacaatctc ctagtttatc ttctttaaca
21361 ttatcttcca tcattaacat ttcagttatt tgttgttcag gattcatatt aagttcaata
21421 agggcatcat gtaatcccat gaaataagcc atttctttt ctgtctgatt acctggtctg
21481 cttcctaaat cttctgatac tggtgaaatt ataaatacta gctttctatt tttattaaga
21541 tagtctgcgt aagcacaggc tactgagcac attgttttac ctgtaccggc ttgactctca
21601 ttccaaagta tttcaacatt atcattaaag aaatcctcac agaaatctaa ctgctcggtt
21661 gtagcttttt caaggaattc attaaagact agatgttctc ccatgttgta tcttacatta
21721 ggataatctt ttaacttaaa gtctaactct tttagttgta ttgccatatt ttaaagttcc
21781 cctatctata aatagtttta ctctcttta atatagtact aatttccgat atattctcct
21841 gttgaagagc aataattact acattcacat tcagggtagt tatcacaaac atcttcatct
21901 tctacatcat cataaccaat atcataatta ttataattaa aatctacaat acaattttca
21961 ctattacctt tagataatcc tgtataaata atatcatcca cagaatccca atcgttatct
22021 gccaagtaat ttacactatc tagtactgat tcattatcag gtaaataaat actaccgtct
22081 gaaaatttaa ttaaaatatc accttgaggt aaggtatcat taattaaatc aatctctgtt
22141 tcttcttcaa tagtgaatac agttccttct aatctttccg gtgtagtatg tgttaaatgt
22201 tttacagtat cccctgattc ttcatagaat cctactgcat tcatatcttt attatatttt
22261 gcaataaatt taccattgtc acttaccaaa tattgactag ttgcattata gtcgtttgcg
22321 tcatctactg tcatgcaagg gttataatct ttaacataat aactaatttt cctaacatct
22381 gctgtttgta ctttcttacc ttcacccttta attactgaat taattttctt cataatattt
22441 tctccttttt atatatcaat tgatttttt gcaagattat cggcatagtc attccatttg
22501 tcatttgaat ggctctttac ttttacaaag tttatatcta ttacttttttg gtattctcgt
22561 atcatattaa tatatgtttt acttagaata tttcttgcag accaagtacc ttcataccaa
22621 tgtattaaac caatataatc tatataaact attgcctgat tgtatcctga ttttatagcc
22681 tcttcaatac cataacaaca agccaatatt tcacctgcaa cattattata ctttattaat
22741 cctggtttgt caacactttt actaatttcc gatattatat ttccttcttt acttaccaag
22801 acagcacctg agcctacttt acctttatta tatgaggagc taccgtctgt gtatatattt
22861 acactatcct gcatacttat aatcctccat aaattgaggg aattcacaat ctgaatagac
22921 ttctctgcaa aaagatactg agatatagtt aaaatcaaaa catttgaaac agtgttcttg
22981 aacttctttt ttatctttag caatcacatt aaattttaaa ccatcagcta ttactgtaaa
23041 tactcctttt ttcataaaac aaatacctcc actaatttta tttttaaatta ataactaact
23101 caataaatga tttaatagtt ttatttttac cttcatcaat atctgaaaag aaattaatta
23161 aactgtcatc ctcatcaaat aaatcttcaa catcatcaaa tttatttaat atgtctgtaa
23221 cactgtaacc ctcttctgat atatactcat gtaagtcttc tccatcttct gacagtgttg
```

```
23281 cttctatttt accattttta ctttcaatta aatataaagt atttaacact ttaacagaat
23341 ctacaactac actgtagtta ctaatagtag gatactctgt ataaagtatt tctacattag
23401 tattcatata actatcaatt acagagttaa ctgtatctct tttagctca gatacattat
23461 gttttcgtat agtaggaaat tcttcatcat attctactaa ttctttcta tctgtattca
23521 ataacttgtc taaagaggac aacaatacta tttatattg gttatcagga agactgtctg
23581 taatttccat tattgttaaa aacgtatctt cacctagaac tttgtttata tcttgtaatt
23641 caaatgaatc taccatttca atagtatcat ctatatcatc tgtagtcatt aaaaaattaa
23701 ctaaattatt attctccatc gtcttcctcc aattctttaa ataactcttt tcctggagta
23761 tttaacgctt tctctaaccg cattaaatta gcacttcttg gtttctttt tccatactcc
23821 caataagata taagagagta atgaacacct atctcagaag ctagacttct taacgtatgt
23881 ccttttctta ctctaatttt ttgaagggttt agaggtttac tttccttttt ttcatccata
23941 attatttctc ctctacttt aaaaatttaa aatcctcaga tgcttttgca tttttagta
24001 tatactcttg tgatttattt cttgcctctg cctttactttt agcatataac tctatatgaa
24061 atacatgagg ttttttaaa gacggtgact cgtatctcca ataaacttta aaaagtagtg
24121 tttctttttt taaaacatta attcgaaacc atcttttaaa tttattcatt cattatcctc
24181 ctctatttat ttgttaaact aattatagca tagttaactt atgaagtcaa ctataatata
24241 caaaaaaga ctaagaaatt aatcttagtc ttaatatatt aataactatt atgtgcgttg
24301 tggtatgcaa gagctcctga tgttgaaccg taacggtcaa tcatatattg tttgcacct
24361 ttagtttgtt ctgctataga accaccactc catgatttac ctaatccttg gaataatcct
24421 tgagctcctg atgatgcatt aacagcatta gggttcattg tagattcacg catagcaatt
24481 tcaatcattg cctcgtctcc acctgcttgt ctaatctgtt ctgctacaga gcctcctgta
24541 gaactagttg attgtgtagg ttgtttagtt tccttttgaa ctggtgctga tgttgtttgt
24601 acttcttttt tagtatcttg tttatttga gtatcaaatt gtgcttgttg ttggtctact
24661 tttgttcag gtgtttgttc ttctcctgct aatctagata ctgtattatc tacttgagtt
24721 gagcctgaat ggtattcata accaaagtta ccattataat tatagaaatg ataagtaaat
24781 tcaccatcac taaaagagaa atcataatta cctgcttgaa ttggttttgt atttacttct
24841 gctgaatttg atttagcttg ttctgctaac ttattataat caattcgtc tgcactagct
24901 tcatttgtag caatacctcc aaaagtaata gctgtaccta atgctaatgt tgcaaaaatt
24961 gttttcttca taaatttaaa actccttaaa taattttta gaattgttta tttgtaaacc
25021 gacataagta atcataacat atatctttaa ataacgcaag tataatatag cactaattag
25081 tgtaatatta ttaaggtttt attacaaaca ttacagttat cagataatta aatacaaaaa
25141 aagagaggta attatattta ccactctcca gtttcattat atttattat tacattatct
25201 cttaattcta tagcctcttc taaagattt gcactaaaat atttaacttt attttttctt
25261 acaatttgta tattatatac attatttgat ttttttgtata tattatgtgt acttttcttt
25321 cttatattag ttgagttttc agacctagta gaccacttaa cattaccagg ttcataatta
25381 ccatcattat ttattctatc tatttgataa ttttcatcg gagggtctcc catatagtcg
25441 tagaatttt taaaatcatt cttccattct tcacatattt ctataccct tcctccatag
25501 tttttataat ttatagcgtt aacatcgtaa caacgctgtt tcatacctaa ccatctttgg
25561 tacattgggt tactggataa tccatgggta gtattccttt ctctcattaa ctcactatga
25621 attttattac tctcacaccc acaagatttt attttacctt gccttaaagt ggagcttcta
25681 actattatta cttctccgca ttcacataaa cattcataca tttacatct tgatttatcc
25741 ctcttactag actctttat aacttttagt ttattaatag tttctccaat cataatatct
25801 cctcctataa taaaactata gcataaaaaa ccacctatgt caataggtgg ttaaacatat
25861 tattttattta agtttgtaat aacactatct gaacctatac taataggttg ttttccattc
25921 cattttcaa ttaattgttg ttgtaaaact tcctctgtta aggattcact tctaatgtca
25981 ttggcttct tttcaccttt tgcttcaatt tcttttcttt tagcgttttc ttctgctatt
26041 tgcttatcaa cttagtgcg ctctagttct tggtttgctt ttactctctc atcaattgct
26101 ttttgagtat ttttatctgc agttgggctt gataatgcaa tatcatcaat aataaaacct
26161 tgcttttcta aattatcatt aagtttattt aaagtatctt gtttaatttc tcctgttttt
26221 acaccaaaag catcaattac agagtactta gaaattgctt gtctaacatt atcttgtact
26281 ctagaacgaa gatacccttt ttcaagttct tctatgtcag cacttccgaa tctattaaaa
26341 aggtttactg ccttagttgc atctacttta taagatacat caatgtctaa tttaatattt
26401 ttaccatctg aagttgctac atttaaatct ttatatttat gtgtttgtgt tttagttggg
26461 tatttattta ccttatcaaa aggtgctgtt aaatgccaac ccggtgattt agtatcttcc
26521 ttaacaccat ttactgagta tacaactcca acatgacctt gtggaatctt agtaatacac
26581 attaataaaa taataaaccc tataattgct aaaaacccta atactcctga aataactact
```

```
26641 gactttctca ttacatttct cctttttcta tttctttttat taagctattt aaagcttttt
26701 cctcttggtc tatttcttgt ttatcggctc tagttacaat tgattgtcta cggtcatttta
26761 agaattgttt tttatacttt acatattgtt ctaaaccgta ttcatctaat gtaccttgcc
26821 taactaattc cctgtattgt tttcttatgt tactcttctt ctcttttcatt gaaagaaaat
26881 caaataaata acttatacca aaacctacaa ggactagaaa aacaataaaa atagcaaaat
26941 atgttaaaag tagtgccatg taattcctcc tttatttgat tacatatata actatacact
27001 atgtatttaa ttttgtcaac acttttttgc aaaaaaaata gacggatttt aaatccgtct
27061 aaatttatat tctatttgaa tactccccag gcaacgccag gtatttgatt aggtggaaca
27121 ccttgacaag ttctaacagg gcaatatact ctgttaccgt tgtaagcatt ataacctatc
27181 caaatgtgac ctgcttggat acaaacttcg tcatatacaa ttgtagcccc tgccggtaag
27241 ttaccgccta ctggagcatt taagaatgga gaacctattc tagttactat aggttggtta
27301 ccattgacaa atgttgcatt ttccggttta taccaagttc cgtactggtt cttttttccaa
27361 gaacctgtaa ctggtctagt tgccggtgta cttgcgctac ttgttttacc atctttaact
27421 actgtagaac ttgaagttcc tttatccatg tagttttaa tttgtttaat gaaataatct
27481 tttaatttat tcattattgc ttgtgatggt cttccttgtg ttactggatt aaatcctgta
27541 tgaagaacca tagaacggtg aggacaggca gttggtacaa attccatatg caatcttaca
27601 gttttacggt taggagtaag acccccattct ttaaatttct ctgctgtaaa ttggaatact
27661 gcttgttcat ttttaaggaa ttgagcatca ctagcactca ttgattgaca gacttcaata
27721 cctgcaaatc taaagttacc tgagtttgct cctgttccat ccgattattc aataaaagac
27781 gtaactcctt taccggttct cttatgaact ccttatagtt tcctataaga ctagactata
27841 tcttcaccct aatttgtta ggggttctcc atttcgatt aagggattct cacccactcc
27901 attaacttga gccctactcc tattgacgat ttattttat tggcactcgt ccgagggata
27961 gtcgttgaac cttaatattg tttccaaatg tatccgtagg ctgtttttct ctctccttg
28021 atacatcttc ctatattacc acttctttta ttagaaatac ctaagaactc taaagcctct
28081 tgagctgtgt aaaagacatt caataaatta cctctaagt catactgagc tatattataa
28141 tttatttcat ttttlaatcc tgtctttatt gcatgttctc tgttctcgga attagaaacc
28201 cattctaaat ttcctacact attatcattt ttaccattta aatggttaac ttgttcttta
28261 ttatcaggat taggtataaa agccatagca actaaacgat gtatttagg tgaatggtat
28321 cgtaaccta caaacaagta acccttgtta ttttttgaa gttttaactt tttaggctct
28381 ttaccttat aagatattac ttctcctta tcagtaatag tgtaatttc atataattct
28441 aatccaggta tttcatttaa tttcttttcc ataataacat ctcctttact taagtatata
28501 ggaaagttat tatgttgtca agtagttttt taaaacaata ttcttggatg ctgattagca
28561 tagcttgata gccttagcct cccagtcaat taaaagaact ttcattatac attactgtat
28621 aacagggcaa tttatttacc cgtgtgccaa gcaatttgat tctagcatc tattgcttcc
28681 catacataac cttcagagcc gtagtaatga gcaataccat tagcgtatct agcataacct
28741 gcattagcta atgaattctc gtattgttgt cctgaagaac gacctgcatc gttgtgtatt
28801 accattcctt caggtttttt accacgttta tccattgtat agttaatgtg attcttagaa
28861 acttttagtg ttgcttctt tttaggtgca ggcgtttttac ttgcgctttt cttagctgtt
28921 tcttttttaa cagtagttcc tgctttaca ggtatttcaa tgaagtgagt taatccgtaa
28981 taattatcta cacgtttgt aggttttta ttagcataac cattccagtt ttgctctaaa
29041 atagtaaatg tagaagtatt acctccatca tatacaatac ctatgtgacc ccactgttca
29101 taactaccgg atgtaaatac cgcaatccaa ccttttttag gtacagtaga aggtttattt
29161 tcatgtattt taaatccagt accataactc tgtttaattt ggtctttagc attaccccaa
29221 gttctaactt tattatctgt taaccataaa acatagtctg taataaggtc ttgacactga
29281 gcgtgatagt aaccatctgc atcaatggct cctgcttcca ttacaccaaa tgatgggtca
29341 taacttgtag cttttttaac tctgtaaggg ctatctactg ttccttttgc ataagcatct
29401 aaacgtttat ttatttctgc ttgagtcttta gccattactt aacttcctcc tctgcaaata
29461 ctttaccatg ttcctcggta tcttcttcat cttgagaagg tgctgaacca ccatcaattt
29521 catcttcaat agcaggtact tcatcactat catctgtgtc aggttctgca ttgtttttcgt
29581 agctgtctat ctcaaaagta ctagtgttat ttgcatttgc ttgccattga acgaattcat
29641 tagggtcttt actatcacga ggtttaagat agtctgtttg aacaatatca ctatctttaa
29701 gacctttagt attattatca acaataatac ctaaacctgc taatagtgtt agtatagaac
29761 ctacaatatt tacaccttgc tcaatttgag ctgagtagtc taaaccgaaa gcacctataa
29821 tttggttagc aaataatgct actgctgata taattgctac ccaaaatgtt ttgctcttag
29881 ttcttgtgct aaggtttatt cctccaacaa cttlaggttg tttagtttca ttagccatta
29941 aaaaaccgac ctttctatta tatttatttc taacaataat ataacagtag gtcggtcatg
```

Figure 17 (contd.)

```
30001 tttatctata ttaatttaac acttactcat taatttggtt tagtttttg ataacttcag
30061 acatttgttt gttatctaaa tcttctaatt tagtttcagg aagtagctct aacttatccc
30121 aaacttcttc tttattagat actttattat taataattgc cttaccaact aaacttccg
30181 tataatataa ttgtttgct gatgccattt gtatctctcc ttttaaatat gtaaagtata
30241 tagctagtat cgtatcctag gaacaaaacac ttgcgctata tactcaatga aatcctaccc
30301 tcattcgagg acacagcaaa ccggttcgtc aaccgcacat atgaattctc agatttcatt
30361 tatgtaaaac acaccctctt tgatttgcac aaagactaag ggttttggag acccttgtac
30421 tactaattat actaagggtg tttattatgg tttctattgg atttgaacca atgacaccta
30481 gagcttcaat ctagtgctct accatctgag ctaagaaacc ttaaaacgac ccatacgaga
30541 ctcgaactcg tactctctgc cgtgacaggg cagtgtgtta accagttaca ccaatgagcc
30601 aaaattataa tgctataccc taaccttacc ttaatgtata gcaggttttt atataagctc
30661 gaagcaacga ttattaccac tcataacaac tatatattaa gtgaaaggag gtgaaatgaa
30721 caaaacgtgg taattggtac ttatatagga aatatgtata atctacaagg agtaagttat
30781 tggttcataa aggagtgtga acaataaata catgaaagag tgaaagttta ctccctgtag
30841 attcttttt taattatcaa tcaaggagg aaactgataa ttgttaataa taaactataa
30901 agaggaaaat atttatagtc acattctgat ataatgcaac taaatatcca agcataaccc
30961 gtctcacgag gaacctacct ataagacctg ttattaagtg aatcactacg attgactcta
31021 ttaaggagct accttaagtc catctcacgc aatttaaaag ggacttacaa accgtaaaac
31081 ggtaataagt ttattaaata atgtgatatt aacatattag ttaataactt tcacatggtc
31141 gaagaaaagt aaatttattt gattaccaaa ttattttat caaatatagc tctttgaac
31201 ctgtagattt atgctactta tactgataac ctctatatc taacacattt ctgtgctcca
31261 actacagtta gtcgttacag cgtatctttc taggattccg ctaagaccct aaaaagaaat
31321 taaaccctag ccgttatcat actctacaga ccttataagt aagtaccaag tataccaatc
31381 gtatttaaca atactaatga cgacccatcc taccgatata tctccgatag gttttgattc
31441 gtttgattat cttgtaccctt atgactacca aatcattatt cagtcactat gctcagatat
31501 ttagttgtat tatttatata ttaattataa cataattttt attacttgtc aagttaattt
31561 caaaaaaatt atagaagtag ggacgtttac ctacttctat ttaatttaca caaggatgat
31621 aacattgtta ttgtttata ctggaaaaca atgtaataaa aacagtgatg tgtaaggtat
31681 ttgttttatt gttaattata ttatagcata tactgatacc tttgtcaagt taatttaata
31741 cttttttaa aacattagtt atctttgtt agttcctcct gaatagcatc ccatcttctt
31801 tctgcttcac tacgattatc ttctatatgt tttgtagttt tacaacattt gatacaatat
31861 atatctttga tatgaccttc ttctctttta tttgctcttt ttcttggtac tttgaataca
31921 tttccacatt ctttacatat taaacttgag taaaacattt tttgtcttt cataattaat
31981 caattccttt tctctttat ttgataattt aactatatac tatattgata aataagtcaa
32041 cagtttcta aaaataattt aaattatttt gaagaatact ttaatatcaa gggttacaag
32101 agaaaagta cgtatttaga aaataaggag tactcctatt atatataatt atattctgat
32161 atagagtaat aaataatatt aaatatataa ttataattaa taaggttggg aaaattgata
32221 taaacataac tgatactgct tatagatact cagtataaaa gtaaaatccc ttagtatcag
32281 tacttacagg caaaaaagta cgtatttaga aaataaggag ctctcctatt atagttatat
32341 atatttatta ctattattaa ttactatttta aatatataat tataattaac aatgttagaa
32401 agtcaacaat agtataaata aaaaagtgac tacttaaagt cactcaataa ttagaatact
32461 attttaaaag attctattct gtttggatta atatatactt gaggtgaagt tatagcactt
32521 tcagtatata cttttataga ggtttcatcc attcctctta acatataatc tatatcttgc
32581 ctattgtaac tcttttcatc agtagatact aaaaagtatt tagctccact tgacattgtt
32641 atttcaaatat gttttgacat ctacaatctc tcctatgcaa atttgttaaa gacaaaggat
32701 aatatagctc ctagaacaag taaaagaacc ttctcagttg tatcctttt cttagtatcc
32761 ttagttttg tacttcagc aagttctgaa atctttcat caagtctttc taattggacg
32821 taaattgctg attgttttc actattgaca gctacatctt tatctatact aactatcatt
32881 tttcttagtt cagctaccctc aactctaaa tctttgaaag ttcctctatc tatataatta
32941 ccttcttgta tcttagactt aatagtttct acttgagaaa caaggttgtt tatctctta
33001 tccaactaga atcacctcta aggtctaacc gtttcagatt cagaatggat atcataattt
33061 tctaagaaat cattgataat ctccatataa ttatccgtaa cgactttcc gtaagatgtt
33121 tttgtatcaa tttcaaacct aagcttacca aaactttgga ggtctaattc ttttattaca
33181 atattagggt catcagaagg aaggtaataa tagtcgaagt atataattga gccatttatt
33241 aatactctgt ctattctata gacgtggaaa tagcgtctgt ctcttttaaa atgggctagt
33301 gcatctttaa actctaactt aaggatatcc ttatatttag tcaaagtggt aacctcctta
```

Figure 17 (contd.)

```
33361 ctattaattt ttaaatttac ttattttgtg gtataatagt tatgataaag gcagttatta
33421 taattatatt aagaataatg ataataatta tttttctga gaaaataagc caaatactaa
33481 aaacagataa agcatagata gctgatagat atactatatt aagagttacc ttactttat
33541 cttttctata gatagaataa cctaaagacg ttgtaacacc actaagtata aaataataga
33601 aacaaaaaag aggtatagac agaaaaaaag atacgataat cattgttaaa cacctatttc
33661 tttttgacct attattcta gaacttttag attacaccac taatataaca ttaaaagcca
33721 gtcataaaag tcaattgtta gattaataat ataataaaaa aagacaatag gaggttaaag
33781 tggttgaata ataacatagc tatattcata ttcaaaacac tggttatcat tatattctta
33841 ctactaattt tgtctgttat taattccttg tcccttattt actcaataag accgagtgta
33901 gttatgacat actttatctt tggtggtatt gtttctaatg tcgcacttac tgtaacagat
33961 aagttcttac tgaagaaaga agaccccccta cctgaatatg ttcttaaaaa agtagagata
34021 aatgataaag aaataagaat aatcaagaaa ataatagaaa gtaattatgg tataacagca
34081 gaagagataa aagttagggc taaagcacaa agaagagtag aggaagatag taaaaaggaa
34141 gattacaatg aaaacaaaga aagaaattaa agaacaaagg aaagaacta aggatggtgc
34201 tacatctgtt tctttagtaa aaaagggaga taagagaata gctagcccta gtagaatttg
34261 tagtctatgt ggtcagcagt tatcaggtat gaattacact aaaggaaaag cattatcaaa
34321 agttaatcat tttcatttac agtattctaa gtatatttat tttgatattt gcgcagatat
34381 caacaattgt tataaaaatt taagaaaacg aggtgaaatg gattgagtgc agaaaatatt
34441 agagatataa ttaacaagaa aaagttagaa gaagaggata caagaaaata tatagctgat
34501 gggtttatga atggtatcgg taaattaatg tacgaattta ataagaaagt agataacaaa
34561 gaaatagaag ttaaagaccc gaatgattta tacaaaattat ttgtgatatt ctctcaaatg
34621 caaaatatgg tcaatgaaac ttctgaagga ggagcaatac ctcaactatc tagacctcaa
34681 caggaattat ttgatgagat tacaacagaa gatagtaatg gagaatctac agttgattta
34741 cagaagatat cagaaatgtc agcggaagat attacagcaa tgatttctga aaaggaaaaa
34801 gtaatgaatg aggaaaattc agaaacattc taaggagaaa gatataaatg gatggaaaag
34861 aactaattaa gatagcacaa gaaacatttc aaactgaaaa ataacaaga gaacagatag
34921 accatataat caatatgcta aatccttcta cctatatgct taagtatcat acactgagag
34981 ggcatcctat aacttttagt attcctaata gagatagaag taaagcacag gctcatagac
35041 cttggcaaac taggattgta aatgatactc atcctaataa ggctgtaata aaatcacgtc
35101 agttaggtct tagtgaaatg ggtgtaatgg aaatggttca ttttgcagat atgcatagtt
35161 atgctaatgc aaagtgtctg tatacattcc ctacaaacga acaaatgaaa aaatttgttc
35221 agtcacgttt gaaccctgtt ttagagaaag aatatttag agacattgtt gattgggata
35281 aagactcgtt aggttttaaa aagataagaa actctagttt attctttaga acaagttcta
35341 aagcaagtac tgtagagggt gtggatattg actatttatc tttagatgag tatgacaggg
35401 taaaacttatt agcagaatcg tctgcattag aatcaatgtc ttcatcacct tttaagattg
35461 tgagaagatg gagcacacct tctgtacctg ggatgggtat acacaaatta taccaacaat
35521 cagaccagtg gtattacggt catagatgtc aacattgtga ttacttaaat gaaatgagtt
35581 ataatgatta caaccctgat aatcttgaag aaagtggaaa tatgttatgt gttaatcctg
35641 aaggtgtaga tgagcaagct aaaacagtac agaatggcag ttaccaattt gtttgtcaaa
35701 aatgtggtaa accactagat agatggtata atggtgagtg gcattgtaag taccctgagc
35761 gtacaaaagg taataaaggg gtacgaggat acctaataac acaaatgaac gctgtatgga
35821 tttctgctga tgaattaaaa gagaaagaaa tgaatacaga atctaagcaa gcattctaca
35881 actatatttt aggttatcct ttgaagatg ttaaacttag agttaatgaa gaagatgttt
35941 atggtaacaa atcacctatt gcagaaacac aattaatgaa acgagataga tattctcata
36001 tagctattgg tatagattgg ggaaatactc actggataac tgttcatggt atgttaccta
36061 atggtaaggt agacttaata cgattattct ctgttaaaaa aatgacaaga cctgatttag
36121 ttgaagcaga tttagaaaaa ataatttggg aaatatctaa gtacgaccct gatattataa
36181 ttgcagataa cggggactca ggtaataatg ttttaaaaact cattaatcat tttggaaaag
36241 ataaagtatt tggatgtact tataaatctt ctcctaaatc taccggacaa ttaagacctg
36301 aatttaatga gaacaataat aggggttacag tggataaatt aatgcagaat aaaagatatg
36361 tacaagcact taagacaaag gatataagtg tttatagtac agtagatgat gatttaaaaa
36421 ctttcttaaa acattggcag aatgttgtta ttatggatga agaagatgaa aaaactggag
36481 aaatgtacca agttatcaaa cgtaaaggtg acgaccacta tgcacaagca agtgtctacg
36541 cctatatagg attaacaaga ataaaagaac ttcttaaaga aggaaacggt acaagctttg
36601 gttctacatt tgtttctact gattacaatc aagaaggaaa taaacaattc tactttgatg
36661 aatagaggtg aaatagactt gacagataaa ttatttatg gtacaattag taatgaagaa
```

```
36721 attaataaaa gtgtattgaa tttgttattg ggtgaggaat tatccttaga ttatgtttct
36781 aaaaatagtg atactttaga tgttaaatat gaacatgttt ataaatctct aggattcgat
36841 aatttctttg attgtttttt atatgctaat agagagcctg aaatagtcca taaaggtgga
36901 gataaaaatc ttggtggact aaataaggtt aaacgtactg ttattcgtaa tggtaaagaa
36961 atggaaatga cagtttacga agatggtaat aaagagaacg atagtaaaga aaaacaagaa
37021 ggaaaagaag aagttagtag aagtgcagta ggagcaaggg ctatttctaa tggtgaagaa
37081 ggaaaggtaa accctaaaaa ggtagcaaat tcattatcta atttaagtaa aaaaggtgta
37141 gatgtatcac atattaatac aaactcatca ttgtataaag agtttgttga tgataacggt
37201 gatacattag gaattacatc ttttaaacga actgaaaatg atataatatt agaatcttat
37261 gcaagttcac atgattcaga tggtgtagga gcaagagcta ttatggaatt attacgttta
37321 agtattaagg aaaataaaaa tgcagttgtg tatgatatag aattacctga agcagtagag
37381 tatttaaaaa ctttaggatt taaacctaat aaagatggat acatcttaag aaaaaaagat
37441 gtaaaacaat tcttaggtga ttatagtgat tttatttagc actatagtca tctattctat
37501 tgtatttatt ctatatattg tattaaaaac aatttatata aagtctaata tgagtagaat
37561 agataacaca actgaattat taaaaatatt acaggaagat attgaaggta agataaaaaa
37621 ggaaggaaga aataaatgac tttagaagaa aataaattaa cattagaaga atcaataact
37681 ccacttagca aagaggagaa agaagatagt attaaagaat ttagcagttt attatgtgaa
37741 atggtaaata gactatataa gtcttataat gtatttagac aagaccctat ggatgaaact
37801 caacgtctag atggctcttt aatggtctt caaagtagat taaatgaccc tttaacagga
37861 gatttacatg ataagatgta taaacttgct ttttcaaaac gtattgatat ttcgaagct
37921 aataagcaat ttagaaaaga tgtagaagca ggtaaagcaa ttgagttagg tgatgtagct
37981 attatagata cagcattaag taacatcctt tcaggcaatg agttccaagg aagtatttca
38041 tttatgctta gaaaagactt tgaagaaaaa gaacgaatta gaaaagaaga agaagagaaa
38101 cttaataact tataaaaggg aagaattatg agactatata aaatgaggta tcataattga
38161 aaaagaaacc acaaggcaat gaggtaatca taaccataat aacggttatg atagcagtat
38221 ttgtagtcat tatgaccata ttttttaata aatatcaaga tgctaaagaa gataaagata
38281 gatatcaaag attagtagag atttataaaa aagcagatga taatgatggt gagactaaaa
38341 agaaatatgt taaagatta aataaggctg aagaagaact taaaaaagta aaaaaagaaa
38401 caaattataa agattataat aagaagtcaa gtaaagaaag acaaaaagaa gataaagaaa
38461 ctagagagaa aatatatgat gtaactggtg atgatgactt aatattagta aaaaataata
38521 ttgagtttag tgataaagta gacaagcccg aaatacttat tagtgaagat ggaattggta
38581 cgataactgt tcctgtagat agtgggtatg aaaaacaaac agtaggttct attattacta
38641 gtgtattagg ttctcctttc ctatcacctg gttcaaatag tatagatggt ttaagtgtta
38701 ttaacgataa tgtttatcca aatacagtag atagcatagt agaagataca aaaccttcta
38761 ttaacttacc aacggataat cctattataa caaatccagt tgaaccaact atacccttcag
38821 atattatacc tcctattgat aatccttcag ttccgatatc tcctgagaac ccaggagata
38881 ataatcaagg aaatacagat aatccaaatc ctcccctcc agggtacaca gatgaagatg
38941 gtggaagagg ctccggtggt ggaggaaatt ctgaaccacc atcaacggaa gaaccttcgg
39001 ataatggtaa caccggagga ggagattggg aagaaaaacc tgacccagga gaagaacctt
39061 cagataatgg taatacagga ggaaatggtg gagaagttac gcctgaacct gaacctgaac
39121 ctgaacctga acctgaacct gaacctgaac ctgaaccatc tgaaccgtct gacaatcctg
39181 atgaaaatgg aggatgggaa actgaaccaa ctgaacctga gtcaccttca gagccggacg
39241 ataaagtgga cgaagaagat aaaaatgaag atactacaga tgataaacag cccactgaac
39301 aaccggacga taacaacata gataatgaag ataaaactga agaggagtaa ttactcctct
39361 tttttgtttg ctatattaaa taagagctaa atataaaaaa attgaacatt acggtggtga
39421 aaactttgtt aggaatgaat attataacgt cactatcagt agtatttact tgtttaagtc
39481 ttttaacttt aatgatttt gttcatagta agttctctag taaaaacgtt ttgttttgt
39541 atgtaattta tgctataata ggaataggta catacatagt tttaactagt tttcaaacaa
39601 catctgtact tattaagaat gatgtaatag attccataga aaatactgaa cattatattg
39661 gattcaatga ccctataatt atatttacta taagttttat aggtgcaata cttggaggaa
39721 tttggtacaa gatgatgaaa attattaaaa agagtaactt taaagataaa aaataaaaaa
39781 gacggtgaat aggttgatat tctctaaaga taaaaaatgg gatgaagcaa aagatttcat
39841 caaaggtcaa ggtatgcaag ataattggat agagattgta gattattata gacagatagg
39901 tggaaaacac gtagctgttt ttattgcttt aaacaaagta aaatacatga ttctagaagc
39961 aacaaaagac aataaggtaa tattagtaga taaagataat aatatactat tagaagatta
40021 tgatattgtt atggaaagta agaagatgtt ttattacatt gaagaaccgt tcgaggttaa
```

```
40081 aataaatatc cctcaacata ttagagatgt aacttataat aatactgttg tattaactac
40141 agtaagaggg agtagaggtg actagtaatt ggcagattta tttaagcaat tcagattagg
40201 taaagactat ggtaataata gtaccattgc tcaagttcct attgatgaag gattacaagc
40261 taacattaaa aaaatagaac aagacaataa agagtatcaa gatttaacta agtctttata
40321 cggacagcaa caggcttatg cagagccatt tatagaaatg atggatacga atcctgaatt
40381 tagagataag agaagttaca tgaagaacga acataactta catgatgttt tgaaaaagtt
40441 tggtaataac cctatcctta atgctatcat acttacacgt tcaaatcaag tagctatgta
40501 ttgtcaacct gcaagatatt cagagaaagg tttaggtttt gaggtaagat taagagacct
40561 agatgcggaa cccggtagaa aagaaaaaga agaaatgaaa cgtatagaag attttattgt
40621 taatacaggt aaagataaag atgtagatag agattcattt caaactttct gtaagaaaat
40681 tgttagagat acttacatct atgaccaagt taactttgaa aaagtattta ataagaataa
40741 taaaactaaa ttagaaaaat tcatagcagt agacccttct actattttt atgcaacaga
40801 taaaaaaggt aaaattatta agggtggtaa gagatttgtt caagtagtag ataaaagagt
40861 agtagctagt tttacttcta gagagttagc tatgggtata agaaaccccta gaactgaatt
40921 atcttcttca ggatatggat tatcagaagt agagatagct atgaaagagt ttattgccta
40981 caataacact gaatcattta atgatagatt cttctcccac ggtggtacta ctagaggtat
41041 tttacagata cgttcagacc aacaacaatc acaacatgca ttagagaact ttaagcgtga
41101 atggaaatct agtttatcag gtatcaacgg ttcatggcaa ataccagtgg taatggcaga
41161 tgatattaaa tttgtcaata tgacaccaac tgctaatgat atgcaatttg agaaatggtt
41221 aaattaccct atcaatatta tatctgcttt atatggtatt gaccctgcag aaattggttt
41281 ccctaataga ggaggagcta caggttctaa aggtggttct actttaaatg aggctgaccc
41341 gggtaaaaaa caacaacaat ctcaaaataa aggttacaa cctttactta gatttattga
41401 agacttagtt aatagacata ttatatcaga atatggagat aagtatacat tccaattcgt
41461 aggtggagat actaagagtg ctactgataa acttaatatt cttaaactag agactcaaat
41521 atttaaaaca gttaatgagg ctagagaaga gcaaggtaag aaacctattg aaggtggaga
41581 cattattcta gatgcttcat tcttacaagg aacagcccaa ttacaacaag ataacaata
41641 taatgatggt aaacaaaaag aacgtttaca aatgatgatg agtttactag aaggagacaa
41701 tgatgattct gaagaagggc aatcaacaga ttctagtaat gatgataaag agataggaac
41761 agatgcacaa ataaaggtg acgataatgt ttatcgtact caaacatcta ataaggtca
41821 aggaagaaaa ggagaaaaat cttctgactt taaacattaa ttaataagcc tagaataaat
41881 ctaggctttg ttattttt tcgtaattta atttgataa atgtaataac tatgatatac
41941 tatatgtaat tgatattaat acataaaaaa tattaatatt tcacttacaa gttattattg
42001 ttatattatt aacgtaaaag taaataaaat aacaagtgga ggtgtagaca cctttggaag
42061 aaataaaatt taatgctttt gtacctatgg atttgaagaa atctgtatca acagcttctg
42121 atactaatga gtattctatc gtttcaggat gggctagtac tccaagtatg gatttacaga
42181 atgatatagt taatcctaaa ggaatagata tagagtattt taagtcacaa gggtacatta
42241 attatgagca tcaaagtgat aaagttgtag gtatacctac agagaattgc tatgtggata
42301 tagaaaaagg tttatttatt gaagcaaagc tatggaagaa tgacgaaaat gttgttaaga
42361 tgcttgattt agctgagaaa ttagaaaaat caggtagtgg aagacgttta ggtttttcta
42421 ttgaaggtgc agttaaaaaa cgtaatataa atgacaatcg agttattgat gaagttatga
42481 taaccggagt tgcattagtt aaaaaccctg ctaatcctga agcaacatgg gaaagcttta
42541 tgaaatcatt tttaactggt catggtacat cacctgacac tcaagttgat gcaggagctt
42601 taagaaaaga agaaatagca tctagcatta caaattagc ttacgtcact aagattaaag
42661 atttaaaaga gtttaatgat gtatggaatg gcgttgttga agatttgagt aaatctaata
42721 gtatgggata tgaggaatca gtccttacgt tacaactagc taaaggttta tctcgtaaag
42781 atgcagaact agcagtaatg gatataaaca aacaaaaact agaataggta aggagaatac
42841 attctatgag taaagaaatg caaaatattt tagaagagta tgataagtta aatgctcaag
42901 aggcagtttc gaaatctgta gaagatgatg aaaagaaatac agtagaatct accgaagagc
42961 aagtagcaga aacaactgaa gaacctgcta agaacctga aaagtatct gaggaagatg
43021 ctaaagaagc acaagagcaa ggtgaaaaag ttgaatctga agaggtagca gaaggcaatg
43081 aagatgagga agttgaaaaa tcagctaaag aatcaaaaga ccctgtagac caaaagata
43141 ctaagacaga aaataagac aacgagaaac gtaaaataa aaagataaa aagaagatt
43201 ctgacgatga agataagat actgacgatg ataagataa gaaagaagat aagaaggaaa
43261 aaactctaa atcaatttct gatgaagata tcacaacagt atttaaatct atcttaacat
43321 cttttgaaaa cttaaataaa gagaaagaaa actttgctac taaagaagat ttaagtgaag
43381 ttagtaaatc tattaatgag ttatcagcaa aaatttctga aatccaagct gaagatgttt
```

```
43441 ctaaatcagt agacactgat gaagaagctg tagaaaaatc agtaacatct acaaacggag
43501 agcaagaaaa agtagaaggt tacgtttcta aatcagtaga cactgaagaa caagctgaaa
43561 ctggtgaagc aaaatcagaa gaagctgaag aagtacaaga agataacaca tttaaaggat
43621 taagtcaaga agaacgaact aagttcatgg attcttacaa agcacaagct aaagaccsta
43681 gagcttctaa acatgactta caatcagctt accaatctta cttgaacatt aacactgacc
43741 ctactaatgc atcagagaaa gatattaaaa ctgtaaaaga ctttgcacaa atttaattaa
43801 tgcacaaagt tgtgttatat tacggtgt aactaaagaa tataaatagg gtacatttta
43861 ctgtacccta cataaaataa aaagaacaca aatgaaaggt gataaattta tatgactatc
43921 gaaaagaacc tgtcagacgt tcaacaaaag tacgctgacc aattccaaga agacgtagta
43981 aagtcattcc aaactggtta tggaatcact cctgatacac aaaattgacgc aggagcttta
44041 cgtagagaaa ttttagatga ccaaatcaca atgttaacat ggactaatga agacttaatc
44101 ttctatcgtg atatctcacg ccgtcctgct caatctacag tagtaaaata cgaccaatat
44161 ttacgtcatg gtaacgtagg tcactctcgt ttcgttaaag aaatcggagt agcaccagta
44221 tctgacccaa atatccgtca aaaaactgta tcaatgaaat acgtttctga tactaaaaat
44281 atgtcaattg catcaggttt agtaaataac attgctgacc catcacaaat ccttacagaa
44341 gatgctatcg cagttgttgc aaaaacaatt gagtgggctt cattctacgg tgacgcttca
44401 ttaacttctg aagttgaagg tgaaggtcta gagtttgatg gtttagctaa attaattgac
44461 aaaaataacg taattaacgc taaaggtaat caattaactg agaaaacactt aaatgaggcg
44521 gcggtacgta tcggtaaagg tttcggtaca gctacagatg cttacatgcc tatcggtgta
44581 cacgcagact tcgttaactc aatcttaggt cgtcaaatgc aattaatgca agacaacagc
44641 ggtaacgtta acactggtta cagcgtaaat ggttctact catctcgtgg attcattaaa
44701 tlacatggtt ctacagtaat ggaaaatgaa ctaatcttag atgaatcatt acaaccatta
44761 ccaaatgctc cacaacctgc taaagttaca gctactgttg aaactaagca aaaaggtgct
44821 tttgaaaatg aagaagaccg tgcaggatta tcatataaag tagtagttaa ctcagatgac
44881 gctcaatcag ctccttctga agaagtaaca gctacagtat ctaacgtaga cgatggtgtt
44941 aaactttcaa ttaatgttaa cgctatgtac caacaacaac cacaattcgt ttctatctac
45001 cgtcaaggta agaaacagg tatgtacttc ctaatcaaac gtgtaccagt taaagatgca
45061 caagaagacg gaacaatcgt attcgtagat aagaacgaaa cattgcctga aacagcagac
45121 gtatttgttg gtgaaatgtc accacaagta gttcacttat tcgaattact tccaatgatg
45181 aaattaccat tagctcaaat taatgcttct attacatttg cagtattatg gtatggtgca
45241 ttagcattac gtgctcctaa aaaatgggct cgtattaaaa acgttcgtta tatcgcagtt
45301 taatagaata agaaaaactg aatacaagag aatagggata aacttagggt ttatccsttt
45361 tttattaaaa taaacttgaa gggatttaat aaatatgtta tactataaga aactattaga
45421 taaaaaatg gctactgttt atggtacagt ggagattgac aaagatggag tagtcaaagg
45481 attaactaaa gaacaagaaa aagaatttgc caatgttcca ggttttgaat ttgaagaaga
45541 aaagaaaact actagaaaac aatcagcttc tactagtaaa gaagaagagc ctaaggaaga
45601 ggaaaagaaa gcctctacta gaaaaactac aaatactact agaaaatcta cagcacgtaa
45661 aacaacagcc aaaaaagatg aaaataagta aagggtgaat taaatggtta actcaatgtt
45721 tggagggac ttagacccct atgaaaaatc attaaactat gaatatcctt atcatcctag
45781 tggtaatcct aaacacatag atgtaagtga gatagataat ttaacattag ctgattatgg
45841 atggtcaccg gatgcagtta aagcatatat gttcggtatt gtagttcaaa atcctgatac
45901 aggacagcct atgggtgacg agttctataa ccatatattg gaaagagcgg taggtaaagc
45961 tgaaagagca ttagatatat ctatactacc tgacactcaa catgagatga gagattatca
46021 tgagacagag tttaatagtt acatgtttgt acatgcttac agaaaaccta tattacaggt
46081 agagaactta cagctacagt ttaatggtag acctatatat aaataccctg ctaactggtg
46141 gaaagtagag catctagcag gacatgttca attattccct acagcactta tgcaaacagg
46201 acaatcaatg tcatacgatg cagtattcaa tggataccct caattagcag gtgtataccc
46261 accatcagga gcaacatttg cacctcaaat gatacgatta gaatatgtat caggtatgct
46321 tccacgtcaa aaaagcagga aaaatacaaacc ttgggaaatg cccctgagt tagaacagtt
46381 agttataaaa tatgcattga aagaaatata ccaagtatgg ggtaacttaa ttattggtgc
46441 cggtattgct aataaaacat tagaagtaga cggtattaca gagacaatag gtactactca
46501 atcagctatg tatggtggag ctagtgctca gatacttcaa ataaatgaag atataaaaga
46561 actattagat ggttaagag cttacttttgg atataatatg atagggattat aaggagggtt
46621 agaaaatgga aaaccgtat atgataggag ctaactctaa ccctaatgtt attaataagt
46681 caacaacata tactactaca acacaagcag atgaacaaga taaacctaag tatactacta
46741 gactagagtt tgatacgatt gacatgatta ggtttattaa tgaccgaggt ataaaagtac
```

Figure 17 (contd.)

```
46801 tatgggaaga agcatatttc tgtccttgtc ttaatcctga tacaggacat cctagagtag
46861 attgccctag atgtcatggt aaaggtattg catatctacc tcctaaagag acgataatgg
46921 caatacagtc tcaagagaaa ggaactaacc agttagatat aggtatatta gatacaggta
46981 ctgcaatagg taccactcaa ttagaaaaga gaatttccta tagagacagg tttactgttc
47041 ctgaggtatt gatgccccaa caaatgattt attttgtgaa taaagataga attaaaaaag
47101 gtataccttt atactacgat gtaaaagaaa taacttatat agccactcaa gacggtacag
47161 tctatgaaga agattatgaa atcaagaata atagattgta tttaaatgaa aaatatgaga
47221 atcatacagt aactttaaag atacttatga ctttaagata tgtagtatca gatatactaa
47281 aagaaagtcg ttatcaatat actaagttta atcaacctaa atcaaaattt gaaaacttac
47341 ctcaaaaatt acttcttaaa agggaagatg tcattgtact acaagaccct tataaagtta
47401 atgatggtat agaagaagac ctagaaattc aagtagatga ccctaaggct tcggcatcta
47461 atcctagtaa tttaggtgga ttcttcggag gtgcatttaa ataatgccag ttcatggaaa
47521 gagacctaat ttatttaaaa ataaaaacta taagcaggta ggtaagagaa caattgatgg
47581 tatgcgttca gaagttcttg ataaattaca agcaacagca cagcaagtag agaatactag
47641 tattaaacgt atgcctactt atctacaaat aacagagaaa aagcttgaaa aagaaggagt
47701 agtagacctt aaaaaagctt ttgctcactc atctaaaaag aaaactagta aagatggcgg
47761 atggtattta actgtaccaa tccgcatcaa aactagtaga atgaataaca gtacttatca
47821 agatatgaga actttaaaag tagataaagg aacaggttca gttcgaaga taactgatta
47881 cctagaagga cgtaggaaga atgtaagcca cccttcaatg aagcctgaac ctatgactca
47941 taatatgact aaagttaaaa gaggaaagca atcttcttac tttatattta gaactgtttc
48001 tagtaagtca cctgctagtt cttggatact taacagagat aaagttaatg aagataactt
48061 ctctaaaaca actctaaaaa ctgttaagca attaatgaac tggaagatga aaaatttaaa
48121 ttaagaggag ggttagtatt aaatggcaat aacatcagtt gattcatatt tattatcaga
48181 aataaagcct agacttaaca ctgtgctaga gaattgttat attatagatg aagttttaaa
48241 agactttgat tatcaaacta gagagagctt taagaagct ttctgtggta agaatgcaca
48301 acatgaagta acggtaggat ttaacttccc aaaatttaaa aataactatg aagctcatta
48361 cttgatacaa ttaggtcaag gacaagagac aaaaaactct ttagggagta ttcagtcatc
48421 ttactttgag gcaacaggag atactttagt cgaatcttct acagcaataa gagaagatga
48481 taagttagtt tttactgttt ctaaaccaat aggagagtta ataaggtag aagatataga
48541 gtttgctaaa tacgataatc ttcaggttga aggtaataag gtatcattta agtatcaaac
48601 aaatgaagat tatgagaact acaatgctaa cattatattt accgaaaaga aaaatgattc
48661 taaaggttta gtaaaaggat tcacagttga agaacaagta acagttgtag gtctttcatt
48721 taatgtagac gttgcaagat gtttggatgc tgtactgaaa atgattttaa tatctatgag
48781 agatagtata gaagagcaac aaacattcca attacagaat ttgtcttttg gtgatattgc
48841 accaataata gaagatggtg actcaatgat ttttggtaga ccaacaatta ttaagtacac
48901 aagtctctca gatttggatt atactattac acaagatatt aataaactaa ctttaaaga
48961 aagaaaggat tggaagtagg atggctagaa aaaagacacc tgaaaataac actcctaaat
49021 ttaatggtta tgttcatata gatacattcc ttgatactgc aaaaaccctt tttaatatga
49081 gggattcaca agtagcagga tttaaagctt atatggaagg tagtcattat ttgtttagtg
49141 agcaagaatt cttaccatca ttagagaagt atctaggtag gaaattagat atataataac
49201 attcagataa ggagaattaa atatggcagt agaaccattc ccaagaagac ctattacccg
49261 tcctcatgca tctattgaag tagatacttc aggtatcggt ggctcagcag gttcaagtga
49321 aaaagtattt tgcttaatcg gtcaggctga aggcggagaa ccaaatacag tttatgaatt
49381 acgtaactat tcacaagcta aacgtttatt ccgttcagga gaattacttg atgcaataga
49441 attagcatgg ggttctaacc ctaactatac agcaggacgt atttagcta tgcgtataga
49501 agatgctaaa cctgcttcag cggaaattgg cggattaaaa ataacatcta aaatctacgg
49561 taatgttgct aacaacattc aagtaggatt agaaaagaat acactaagtg attcattacg
49621 tttaagagta atattccaag atgaccgttt caatgaggtt tatgataata tcgtaatat
49681 cttcacaatc aagtacaaag gagaagaagc taacgcaact ttctctgtag aacatgatga
49741 agaaactcaa aaagcaagtc gtttagtatt aaaagttgga gaccaagaag ttaagtcata
49801 tgatttaact ggtggagctt atgactacac taatgctatt attacagaca ttaatcaatt
49861 acctgatttc gaagctaaat tatcaccttt cggagataag aacttagaat ctagcaaatt
49921 agataaaatt gaaaatgcaa atataaaaga taagctgta tatgtaaaag cagttttgg
49981 tgacttagaa aaacaaacag cttacaatgg tatcgtatct ttcgagcaac ttaatgcaga
50041 aggagaagta ccaagtaatg tagaggttga agcaggagaa gaatcagcta cagtaactgc
50101 tacttcacct attaaaaacta ttgaaccgtt tgagttaact aagttaaaag gcgggtactaa
```

```
50161 tggtgaacca cctgctacat gggcagacaa gttagataaa tttgcacatg aaggcggata
50221 ctacattgtt ccattatcat ctaaacaatc agttcatgca gaggtagctt cttttgttaa
50281 agaacgttct gatgcaggag aaccaatgag agctattgtt ggtggaggat tcaatgaatc
50341 taaagaacaa ttgttcggta gacaagcatc attatctaat ccacgagtat cattagtagc
50401 taactcaggt acttttgtta tggatgatgg acgtaaaaac cacgtacctg cttacatggt
50461 agccgtagct ctaggtggtc ttgcaagtgg tttagaaatc ggtgaatcaa tcacattcaa
50521 accactacgt gtaagttcat tagaccaaat ctatgagtca atagacttag atgaattaaa
50581 tgaaaatggt attattagta tagagtttgt tcgtaaccgt actaatacat tcttcagaat
50641 cgttgacgat gtaactacat tcaacgataa atcagaccca gttaaggctg aaatggctgt
50701 tggggaagct aatgacttct tagtaagtga gcttaaagtt caacttgaag accagtttat
50761 tggtactcgt actattaata caagtgcttc aatcattaaa gactttatcc aatcttactt
50821 gggtcgtaag aaacgtgata atgaaattca agacttccct gctgaagacg tacaagttat
50881 tgttgaaggt aacgaagcaa gaatttcaat gacagtttac ccaatcagaa gcttcaagaa
50941 aatctctgtt agcttggttt acaagcaaca gacattacaa gcctagtcta ggtgacgag
51001 tacctggatt aggtactcct attaatataa tttgaatact ttaggagagt gaatacagat
51061 ggcatcagaa gctaaacaaa ccgtccatac tggtaatacc gtcctactta tgattaaagg
51121 taaaccggta ggaagagcac aatcagcatc aggtcaacgt gaatacggta caactggtgt
51181 atacgaaatc ggttctatca tgcctcaaga acacgtatac ttacgttatg aaggtacaat
51241 tacagtagaa cgtttacgta tgaaaaaaga aaactttgca gatttaggat atgcttcact
51301 tggtgaagaa attcttaaga aagacatcat tgatatttta gtagtagata acttaacgaa
51361 acaagttatt atctcatatc atggttgctc tgcaaataac tacaatgaaa cttggcagac
51421 aaatgaaatt gtaacagaag aaatcgagtt tagttactta acagcaagtg acaaagcacg
51481 tacttaatag attagaccaa ctaaaaagtt ggtctttttt tattgacact ttaaaattta
51541 tatgttatta taaatataat aatttaaaca ggagatgtac tagatggcaa ataagagaaa
51601 aacaatagga aaaatgagta acacaagagc aacatggaat attaatccgg taactaaagt
51661 taaaaaagat aaaacaaaat attctagaaa aaataaacat aaaggtcttg acaattataa
51721 ttaactaagg tatattatta gtataacaaa aaaaggagat gggtatatga gtacattttg
51781 gtcagaaaga agaacaacta ataaagatag gcaagttaaa aaacattata ctcaaatgag
51841 tatgtatgaa agaaagaaat gtgtagagtt attacaagag acaattactg aaaatagaat
51901 tattaatttt acacgacata gtgcaaaaaa ggttaaaggt aaaccaacaa caaatatacc
51961 taaattaata ggttttattt ttaaaaataa gtttgcctac gaaaatatca tagagtacaa
52021 taacacagat tataatggta atattgagag gagaattgtt gttaaacatc ctaaagttat
52081 aactgtagaa ggaaaaccta gctatcagtt ttgacaatt agtcttgaag atgctagagt
52141 tattacggtg tggtataaca gtgtagatga tacacataga acactagatt taaattatta
52201 tagtaaagac ttgacaattc aataaggagg tattataatg ggtataacaa tagtaaatag
52261 ttatttatt ctgtctagca ttttcctcat catattaacc atattaaatg gtaagggtac
52321 agttacaagg gaatcattaa ctatgagtaa aatattagta gtaataacat caattcaatt
52381 tttagcatgt ttaattatta atggtattta ttggtcacta aaatttatgt agtagaacta
52441 gaataaaagt attgacaaat taaaactaat aaattataat aaaggtataa caaattaaag
52501 gagaagatat aaaatgtcac aagataaatt aagagcaatt tacacagaaa tgaaagtaga
52561 attacacaaa tttcctaaag aggtagatat aacaagtaaa tcaactgcaa ttgcaatcaa
52621 tcagattta gataaattca aaacattaac agaacaagca ggaaagatta ctagaaaata
52681 tttagaaggt caagaaatat taactattga ttatgagtat tatgattcat tacaagaata
52741 ctatatttac ctacttagaa atagtgaaaa gattgaacaa agtttacaag aaattactaa
52801 gcgtacaggt gaatatgtaa agtaattttg attttaaaaac aaaatatgat atactatgtt
52861 taaagtagta agcctacact agtccgtgtt atattaatat tgaatcggat aagcgtaggc
52921 tttattaata tttaaaaaag gaaggtatat catattatgg cagaagaaat taaaaaggaa
52981 caagatgtac aagaaacaac taaagaagaa aaaaagatg ttagtaaaat gacaccggaa
53041 gaaatagata aattaaaata tcaagacaaa caagaaaaag aacaagttat taacaaagtt
53101 attaaaggcg ttaatgatac tgggaaaaaa gaatataact ttgaagaact agacttaaga
53161 tttaaagtta agattaaatt acctaatgca cgagaacaag ttaatatctt tgcgttacgt
53221 tctgcttact taggtgtat ggatatgtac caaacagacc aagtgattag agcatatcaa
53281 atgttagcta ccttacagga gtaggtatt gaagttccta aggaattcca agaccctgac
53341 gatatttata acttatatcc tttaactgtt atgtatgaag attggttagg attcttaaac
53401 tcctttcgtt actaatagta tagaaacatt agataaagat atagaacgat tgggcgtat
53461 ggaatcaatt gttaaacaac ctttatctag aaatctatgg gctattatga aagagtttaa
```

```
53521 tgttttacct accgagcaaa gatttaagga cttagacgat tatcagatag agtttattat
53581 tgggaatatg aatagagatg tttatgaaca taataaacaa cttaaacaag ctcaaaaagg
53641 tggaaaattc gatagtcaat tcgaagatga tgatagtagt tggtggaatg aatctcatga
53701 agactttgac ccagtacctg atttcttaga tgctgatgat ttagcacaac agatggaagc
53761 taaattatcc gatagagata aggaagaaag agctaagaga aacgatgcag agttaaatga
53821 tgaaacagaa ggacttacta cacaacatct agctatgatg gaatacatca gacagaaaca
53881 acaagaatta gatgatgaag taggaaatgg taagactagt gaagatgacg ctactatatc
53941 acaagatagc gttaataaag cactagaaga cctagatgat gactggtata tgtaaagggt
54001 ggtaggtgat actaccatcc ttatttttt aaaatggatg gtgaataatg atggcaatga
54061 atgacgatta tagattggtc ttgtccggtg atagttcgga tttagagaat agtctaaagg
54121 caatagaact ttatatggat tctttagagt ctaagaatat tgatgctcct ttagataatt
54181 tcttaaaaaa attaaaagta attgctaaag aagttaaaaa tgtacagaac gcaatggata
54241 aacaagatgg taaatctgtt atatcttcta aagacatgga tgaatctatt aaatccactc
54301 aatctgctac aaagaatata aatgaattaa agaaagcttt agatgacctt caaaagaga
54361 atatatctaa aggtattgca cctgaccctg aagttgaaaa agcatatgct aagatgggta
54421 aagttgtaga tgaaactcaa gaaaaacttg agaaaatgtc ttcacaaaaa ataggttctg
54481 atgctagtat tcaaaataga attaaggaaa tgaaaaccett aaatcaagta actgaagaat
54541 acaataaaat aagtaaagat tctagcgcaa ctaaagatta tacaaaacga ttaagagcta
54601 atcgtaatat gactagaggt tacatggagc gttcagaagg aacaggacgt ttgacatatg
54661 accaaggtgc acgagttaga agtgaactag gtaaagtaag ttcttatgag agccaaagaa
54721 aacaaaacca acgtaatttg gaacaagcaa gagaacaata tagcaactat agaaaccaac
54781 aacaagactt gactaaacgt agagctagcg gtcaaattaa taaggcacaa tatgaacaag
54841 agttagcttc tattaaacag gaaatgaaag ctagagaaga actatatct aactatgaga
54901 aattaggagc agaacttgat aaaacagttc agtattataa gggttcagtt caaaaggatt
54961 tccaatctag agacgtagac caacaaagag gaacatttgg tagaatggtt caagaacgtt
55021 tgccatctat tggttctcat gctatgatgg gtactacagc tatggctaca ggtttataca
55081 tgaagggtgc ctcactaagt gaaactaata gacctatggt tacatcatta ggtcaaaatt
55141 ccgataatat ggatatagat tctgtaagaa atgcatatgg agacttgtca attgataaca
55201 aattaggtta taatagtact gacatgttga aaatggctac ttcatatgaa gcatcagtag
55261 gacataaaag tgatgaggac acaatggcag gaactaaaca gcttgctatt ggaggacgtt
55321 ctttaggcat taaagaccaa gaagcttatc aagagtctat gggtcaaatc atgcataccg
55381 gtggagtaaa ttctgataac atgaaggaaa tgcaagatgc attcttaggt ggtattaaac
55441 aatcaggcat ggttggtcgt caagatgaac aacttaaagc actaggttct atagcggaac
55501 aatcaggaga aggaagaact ctaactaaag accaaatgag taaccttact gccatgcaat
55561 ctacttttgc agagtcagga agtaaaggat tacaaggtga acaaggtgcc aatgctatta
55621 acagtataga ccaaggactt aaaaatggta tgaatagttc ttatgctcgt atagcaatgg
55681 gatggggaac gcaataccaa ggtctgaag gtggatatga tttacaaaaa cgtatggatg
55741 aaggtatatc taatcctgaa aacttgacag atatggctga tatagctact caaatgggtg
55801 gcagtgaaaa agaacaaaaa tacctatta atagaagtat gaaagaaata ggcgctaacc
55861 taactatgga gcaatctgat gaaatattta aggactctaa agaaggaaaa ctgtctaaag
55921 aagagttagc taagaaagct aagaaaatgg aaaaagaagg taaaaaagaa ggagaagata
55981 acgccactga ttataaagaa tctaaatcag gaaaaaatga ccaaaataaa tctaagactg
56041 atgataaagc agaagatact tatgatatgg ctcaaccact aagagatgct catagtgctt
56101 tagcaggtct tcctgcccct atatatttag ctattggtgc tataggagca tttacagctt
56161 cactaattgc atctgcaagt caatttggag caggtcactt aattggtaaa ggagccaaag
56221 gacttagaaa taaattggt agaaataaag gcggtagctc cggtggtaac cctatggcag
56281 gtggaatgcc tagtggtggt ggttcaccta agggtggagg ctcacctaaa ggtgggggca
56341 ctcgttctac tggaggaaaa atacttgata gcgctaaagg tcttggagga ttcctagtag
56401 gtggcgcagg atggaaaggt atgtttggcg gggagtctaa aggtaaggc tttaaacaaa
56461 catctaaaga agcctggtca ggtactagaa aagtatttaa tagagataat ggtagaaaag
56521 ccatggataa atctaaagat atagctaaag gtaccggtag tggtcttaaa gatatctata
56581 atgatagtat atttggtaaa gaaagaagac aaaacctagg agaaaaagct aaaggttttg
56641 gtggcaaagc taagggtctc tatggtaagt ttgctgataa gttggtgac ggaggtaaaa
56701 atggtattct ttcacaatca ccaaaagcag gtggaagtgg catagggaaa cttggaaaac
56761 ttgcaggtgg acttggaaaa ggagccggag tttaggtgt tgctacgtct gccttatcat
56821 taataccctgc tttagcttcc ggagatagta aagctatcgg cggaggaata ggctctatgg
```

Figure 17 (contd.)

```
56881 gtggaggaat ggcaggtgca tcagcaggag cttctatagg agctttattt ggtggtgtag
56941 gtgcaatacc tggagcttta ataggtggag ctataggttc cttcggagga ggagctgttg
57001 gtgaaaaagt cggagacatg gctaaaaaag ctaacactaa agaaggatgg aacctaggat
57061 ggactaacgg agataaggat ggtaagaata aattccaaga ttctttatta ggaaaaccta
57121 tatctaaagc atggagcggt ataacaggtc tctttgataa tgacgctgaa gcatccgaag
57181 aagatagtaa agataagaaa aaaggtgtta aaggcgttaa aggagatact aagaagaaag
57241 aaaaaatgac agcagaacaa cttagagaaa agaataacca atctgaaact aagaatctta
57301 aaatctatag tgatttactt gacagagctc agaaaattat tgagagtgct aaaggtatta
57361 atatagatgg aggaacttct gatagtggtt ctgatagtgg aggctctgca tctgatgtag
57421 gtggagaagg cgcagagaag atgtacaagt tccttaaagg aaaaggacta tctgataatc
57481 aggtaggagc tgttatgggg aacttacaac aagaatctaa tcttgaccct aatgctaaga
57541 atgcttctag tggagcattt ggtattgctc agtggttagg ggctagaaaa acaggattag
57601 aaaattttgc taaatctaaa ggtaaaaaat ctagtgacat ggatgttcaa ttagattacc
57661 tatggaaaga aatgcagtct gattatgaaa gcaataatct taaaaatgca ggttggagca
57721 aaggtggaag cttagagcag aatacaaaag catttgctac tggatttgaa cgtatgggag
57781 caaacgaggc tatgatgggt actcgtgtta acaatgctaa ggaattcaag aagaaatacg
57841 gaggctccgg tggcgaggt ggtggaggag ccctatcctc tacttaccaa gaagctatga
57901 gtaatcctgt attaactact ggttctaatt ataggggctc taatgatgct tctaatgctt
57961 ctacaactaa cagaataacc gtcaatgtta atgttcaagg tggaaataat cctgaagaaa
58021 ctggagacat tatcggagga agaattagag aagtctaga tagtaacatg gatatctttg
58081 caaatgaaca taagagaagt tattagtaat tttgtattga cacaagagta gtatcatagt
58141 atactactct tatacatata aaaaataaaa ggaagtatgt gtatatgcgt agaataagaa
58201 gacctaaggt aagaatagaa atagttacag atgataatac atttacattg agatttgaag
58261 atacacgaga ctataatggt gatgagtttg gagctaaaact tttaggattc caaactaaaa
58321 actctatgga agatgatagt tcagttttcc aaataaatat ggcaggagat acttattggg
58381 ataagctagt tatggctaat gatatcataa gaatatttat tacacctaat gatgaccta
58441 acgataaaga aggaaaacaa gaacgactta tccaggtagg tatggtttct caagtatcaa
58501 aagtaggtag ttacggtaat gaccaaactc aatttagaat aacaggtcaa tctttgtaa
58561 aaccttttat gaaatttgga ttaggcgtta ttcaggaagt tcaagctgta ttcctgaag
58621 taggttggct tattgatggt gatggagata atgaagtaaa atttactggt agctcagctc
58681 atgaagtaat gactggtatt atacgtagat ttataccta tatgaaatat aactatactg
58741 aaaaaaacata taatacaatt gataactatc ttgattatga tgatttaagt agttgggatg
58801 agtttgaaaa acttacagaa gtttcagcct ttactaattt tgatgggtca ttaaaacagt
58861 taatggatat ggtaacagct agaccttta atgagttatt cttcaaaaat tcagaaaaaa
58921 cacctggaaa ggctcaactt gtattaagaa agacccttt taatcctact gagtggagag
58981 ctttagatat gattaaagta cctactgagg attttataga agaggatgta ggtaaaagtg
59041 atgtagagac atattctata tttacagcaa cacctgcagg tatgttgaaa gagcttaacg
59101 gtgatgtatt ttctaaacca caattccacc ctgaattaac tgatagatat ggttatacta
59161 aatttgaagt agaaaatatt tatcttagta caaatcagg ttcagctact gaggattcag
59221 attcttcagg tgatgataat ggcacagaac gaggaactta ttctaaaatt atgaaagatt
59281 taagtaacta tggaagagat aatatatctca aaggtataga taagtataca agtaaaattat
59341 cttcaaaata taaaaactta aaaaaagccc aagctaaaaa aattatagag aagtttgtta
59401 aagaaggaaa agtaacagaa aaagaatatg aaaaaataac aggtaataag gtagatgatg
59461 aattaacatc agataacaga ccgaagttga caaaagataa attaagagt atactaaaag
59521 agaagtttaa aacacaagat gattttaata atctaagaa aaagaaaaaa gctaagacag
59581 atgcacttaa agaattgaca actaaatatc gtttggtaa taaaacacat gctacaactt
59641 tattagatga atatatttaaa tataaaggag agccacctaa cgatgaggct tttgataaat
59701 atcttaaagc tattgaaggt gttagtaatg tagctacaga cacaggttca gatgcaagtg
59761 atagcccttt agttatgttt tctagaatgc tatttaattg gtatcatggt aacctaact
59821 tctatgcagg agatattatt gtttaggag accctaagta tgacctaggt aaaagattat
59881 ttattgaaga taagcaacga ggagacactt gggagttcta tattgaatct gtagaacata
59941 aattcgatta taaacagggg tattatacaa ctgtaggagt aactagaggt ttaaaagacg
60001 ctattctaga agatggtaaa ggtagtccgc atagatttgc aggattatgg aatcaatcat
60061 cagacttcat ggggaggtctt atgggtgaag atacttctaa agaacttaaa gaaaaaggtg
60121 tagcagagaa acaaagtagt ggagataaag atggtggttc tgatagtggt ggagctcaag
60181 atggtggctc tttagattca cttaaaaaaat ataacggcaa acttcctaag catgacccaa
```

Figure 17 (contd.)

```
60241 gttttgttca acctggtaac cgacattata agtatcagtg tacatggtat gcttataata
60301 gaagaggtca attaggcata cctgtgcctt tatggggga cgccgccgac tggataggtg
60361 gtgctaaagg agcaggttat ggtgtaggta gaacacctaa acaaggtgct tgtgttatat
60421 ggcaaagagg agttcaagga ggtagcccac aatatggtca cgtagcgttt gtagagaaag
60481 tattagatgg aggtaaaaaa atatttatct ctgaacataa ctatgctacc cctaatggat
60541 atggtactag aacgatagat atgagttcag ccataggtaa gaatgcacaa ttcatttacg
60601 ataagaaata aaggaggata gtctatggca acagataaag aagctaaaga tgttattgat
60661 aaatttatag acaatgtatt taatttgat gtacttacaa aagaaagaat aaaagaaaaa
60721 gatgaagaaa ttaaaaaaat aactacagat gatatgtatg aaaaggttgt gtatatacga
60781 ccttatgttg gagtaataca aagccttaac cctcagcatg ttcagtatga atcattttct
60841 aataatggtt atgatatagagcagaatta agttcagga aagtaagtta tttagttgat
60901 aaagggtcta tacctacaga ttctttatct actttaacag ttcatttagt agaacgaaat
60961 caagaactat taatagatta cttgatgag atacaagatg tgttgtatgg agaatatatg
61021 gaagaagaat atgtatttga tgaagatgta ccattaagta cgatactagc attagactta
61081 aatgataatc ttaaatcctt atcaaatata aagtatatgt tcaaaggtgc tcctaaagag
61141 aatccatttg gaacagataa agatgtttat atagatactt ataacttatt atactggtta
61201 tatttaggtg aagatgaaga gttagcatat cctatgaata ttaactactt ctttacagag
61261 ggaagattct ttactatatt cggtaaagga cataagtata aggtagatgt tagtaaattt
61321 atagttggag atatattatt ctttggtaga agtgatacta atataggtat ttatgtagga
61381 gatgggagt ttatatctat gatgggtaaa ttccctaaag atgaaacacc tataggaaaa
61441 tataaacttg atgattactg gaatgaattt aacggaagag ttatgagatt cgatgaagag
61501 gtgtatattt aatggtagta agattccaat cttccatggg gagaagttta aaaagagtag
61561 attcggatga tttaaatgta aaaggattag tttagctac agttagtaaa attaattata
61621 aatatcaatc agtagaagtt aaagttaaca atttaactct aggaagccgt ataggtgatg
61681 atggtagctt agctgtacct tatcctaaat cttcatagg aagaacacct gaaggaagcg
61741 tattcggtac aaaacctctt attactgaag gttctgtagt attaataggg tttctaaatg
61801 atgatataa tagtcctatt attttaagtg tttatggtga taatgaacaa aataaaatga
61861 ttaataccaa tcctctagat ggaggtaagt ttgatacaga aagtgtttat aaatatagta
61921 gttcactata tgaaatttta ccatctttaa attataaata tgatgatgga gaaggaacaa
61981 gtattaggac ttataatggt aaatcatttt tctctatgac atcaggtgaa gaagagaaac
62041 ctcaggcaac agattttat actggaactg agtatcaaga ttatttact tcttattatg
62101 gtaataagac attaattgag cctagaatac aaaaggctcc taatatgtta tttaaacatc
62161 aaggagtttt ttatgatgat ggcacgccgg ataatcatat aactactta tttatatctg
62221 aaagaggga tataagagcc tcagtttaa atacagaaac acagaaaaga actacacagg
62281 aaatgtcaag tgatgggtct tatagagtta tcaaacaaga tgcgatttta atgttggatg
62341 aagctcaagt ttggattgag tatggtatta gtgaagataa taatttttat attaaaaatg
62401 acaagcataa atttgaattt actgatgagg gaatctatat agatgataaa cctatgttag
62461 aaaacttaga tgagagtata gcagaggcta tgaagaattt gaatgaaata caaaagaac
62521 tcgatgatat aaactacctt ctcaagggtg taggtaaaga caattagaa gaattaatag
62581 agtctacaaa agagtctata gaagcttcta aaaaagcaac ttcagatgtc aatagactta
62641 caactcagat agcagaagtg agtggtagaa ctgaaggtat tataacacag ttccaaaaat
62701 ttagagatga gacttttaaa gattttatg aagatgcttc tactgttatt aatgaagtaa
62761 atcagaattt ccctactatg aaaacagatg ttaagaccctt aaagactaaa gttgataacc
62821 tagagaaaac tgaaatacca aatattaaaa ctagattaac agaactagag aacaataata
62881 acaatgctga taaaataatc tcagatagag gagaacatat aggtgctatg atacagttag
62941 aggaaaatgt cacagtacct atgagaaaat atatgccaat accatggagc aaagttactt
63001 ataataatgc agagtttgg gattctaata atcctactcg attagtagta cctaaaggaa
63061 taacaaaagt aagagttgca ggtaatgttt tgtgggactc taacgccaca ggacaacgta
63121 tgttgagaat attgaaaat ggtacttata gtataggatt accttataca agagatgtag
63181 ctatatctac agcacctcag aatggtacta gtggagttat tcctgttaaa gaaggagatt
63241 actttgagtt tgaagctttc caagactcag aaggtgacag acaattcaga gcagaccctt
63301 atacatggtt tagtattgaa gctatagaat tagaaactga aactatggag aaagactta
63361 tgcttatagg acatagagga gcaaccggat acacagatga gcacacgata aaaggatatc
63421 aaatggcttt agataaaggt gcagattata tagaattgga tttacaatta acaaaagata
63481 ataagttatt gtgtatgcat gattctacta tagacagaac aacaacagga acaggtaagg
63541 taggagatat gaccttatct tatatacaaa ctaactttac atctctcaat ggtgagccga
```

```
63601 taccatctct tgatgatgta ctaaatcatt ttggaacaaa agttaaatat tatatagaaa
63661 ctaaacgtcc gtttgatgct aatatggata gagaattatt aactcaatta aaagcaaaag
63721 gattaatagg aataggttca gagagattcc aagtaattat tcaatcattt gctagagaat
63781 ctttaattaa tattcataat caattctcta atataccttt agcttaccta acaagtacat
63841 tttctgaaag tgaaatggat gattgtttaa gttatggttt ttatgctatt gcgcctaaat
63901 atacaactat aactaaagaa ttagtagatt tagctcatag taaagggctt aaagtccatg
63961 catggacggt aaacacaaaa gaagaaatgc aaagcttaat acaaatgggt gtagatggat
64021 tctttacaaa ctacctagat gaatatataaaa agatttaata ttaaagacct attaattiag
64081 gtcttttttt agttgtaatt taaactagtt cgtgatatat tagtagtatg agatttatat
64141 acatactgaa aaggagagga taaaatgcca caatcagatg gaataagtaa tcttcataga
64201 atagctttac gcttccctaa agaaggcggt ggttatgata tgtatagatt taaagttaac
64261 cctgagaact acacaataga ttcaccacaa cgtacgacag caattaaaac aaaatcagat
64321 attgtaatag aagattatgg taaagacata gaagttatta acttcacagg tacaactggt
64381 tttagacctg ttagagaagc agatggatta aaaacaggta agcagaaaat ggaagagtta
64441 caaagtagag ttagtgaata tgctatgcaa ggtggcagtg gtaatgtaag tggttcttac
64501 ttacaatttt ttaactttac agatgatagt tattataaag ttcatttagc tcctcagggg
64561 ttaaagataa ctaggtctaa agatgaacca ttactttta gatatgaaat aacattagta
64621 gttattggtt cattaacaga agcagataga agtgctgtaa caacagaaga gtttggtaac
64681 gttaaaccta atgcttctca aagagtagat gagggtataa aagaattaga taaaaatgct
64741 cgtaaaacga gagatagaaa caatcaagaa atatctagaa gagaaaatac aatacctaaa
64801 tctacaggag ataatacgaa cgagggtaat agacttaagc aaagcttccc tagtagttct
64861 atatataatc ctagacaatc tactaacgga ttaaaaggta atattgacaa tatggcgctg
64921 ataataggtt acggtgatgg aggtgtatct agctaatgaa taatttata ccacaacctc
64981 aaggtctact tagattttta aataccctag atacagattt aacttcttct catatgaatt
65041 tactggatga agaggtatca tttgtatcta aattttatac accacagcta caattaagtg
65101 aattagcaaa aaaagtattg acaaatataa agacagatga tatacctgta ttagaaagag
65161 aatttaatga taatacaatt atccataaag ctaacgatac attactaaaa gtacaggctc
65221 caagaatgta tatgattcta cagtcgattg tacttgaagc atatgctatt gttaattgct
65281 ttgtagaaaa tccgagctct ttaaaatact taactgaaga agatgttagt ataacacggg
65341 aaaatttaaa ttatgtagct gactacttag gtaactatga tgactataat agtgttgtct
65401 tagacttaag agatttagac ttatgtttta gtgctataga attacaatta cctctaatca
65461 aaaaggaggc taacgtataa tgagatttaa gaagcacgta gttcaacatg aagaaacgat
65521 gcaagcaata gcacagagat actatggtga tgtgagttat tggatagacc tagtagagca
65581 taataattta aagtaccct atttagtaga aactgatgaa gaaaaaatga aagaccctga
65641 acgattggct tctacaggtg atacactgat tatacctata gaatctgatt taacagatgt
65701 atcagcaaaa gaaattaatt ctagagataa agatgtacta gttgaattag cttaggaag
65761 agatttaaat attactgcag atgaaaagta tttaatgaa catggttacta gtgataatat
65821 actagcattc agcacaaatg gtaatggaga tttagatact gtaaaaggca tagataatat
65881 gaaacagcaa ttacaggcac gtttattaac tcctagaggt tctttaatgc tacatcctaa
65941 ttacggttca gatttgcata atttatttgg tcttaatata cctgaacaag ctacattaat
66001 agaaatggaa gtattgagaa cattaacatc agataataga gtaaaatctg ctaatctaat
66061 tgattggaaa attcaaggta atgtttattc aggtcaattt tcagtggaaa taaaatctgt
66121 tgaagaatca ataaattttg tcttaggaca agatgaggaa ggaattttg ctttatttga
66181 ataggaaagg attaaaattat gaaaactaga aaattaacta acatactatc aaaattaata
66241 gataagacaa tggcaggtac aagcaagata acagacttta ctcctggttc agcttctcgt
66301 tcattattag aagctgtatc attagagata gagcaattct atattctaac aaaagaaaat
66361 attgattggg gtatacaaga aggtatcatt gaagcttttg attttcaaaa aagacaatct
66421 aaaagagctt atggtgatgt tactattcaa ttctaccaac cctagatat gagaatgtat
66481 atacccgcag gaacaacttt tacttcaaca cgacaagaat accctcagca atttgaaaca
66541 ttagttgatt attatgcaga gcctgattct actgagattg ttgttgaagt ttattgtaaa
66601 gaaacagggg ttgcaggtaa tgttcctgaa ggaacaatta atactatagc atcaggttct
66661 agtttgatta gaagtgttaa taacgagtat tcttttaata caggaactaa agaagagagc
66721 caagagact ttaagcgcag attccactct tttgtagaat ctagaggtag agcaactaat
66781 aaatcagtaa gatatggtgc actgcagata cctgatgtag aaggtgttta tgtttatgaa
66841 gaaacaggac atattacagt atttgctcat gatagaaacg gtaatttatc agatacctta
66901 aagaagata taattgatgc tttacaagac tatagaccaa gtggtataat gttagatgtt
```

66961 acaggtgtag aaaaagaaga agttaatgtt tctgctacag taactatatc taataaatct
67021 agaattggtg atacattaca aaaacatatc gaaagtgtta ttagaagcta tttaaataat
67081 ttaaaaactt ctgatgacct aataattaca gaccttattc aagctataat gaatattgat
67141 gatgtattaa tatatgatgt gtcatttgat aacctagatg agaacattat agtaccgcca
67201 caaggaatta ttagagcagg agaaataaaa gtagaactaa agtaaagaga ggtgaaactt
67261 aagtcgtggc taatttttta aagaatcttc atccattatt aagaagagat agaaataaaa
67321 aagataatca agaccctaac tttgctctga tagatgcact caatgaagag atgaatcaag
67381 tagagaaaga tgctatagaa agtaagttac aatcttctct aaagacatct accagtgaat
67441 atttagataa gtttggggat tggttcggag tttatcgtaa gaccgatgag aaagatgatg
67501 tttatagagc aagaattata aaatatttac tcttgaaaag aggaactaat aatgctataa
67561 tagatgctat aaaagattat ttaggtagag atgatattga tgtaagtgta tatgaaccct
67621 ttacaaatat tttctatact aacaaatcac atttaaatgg tgaagaccac ttaatgggat
67681 actattatag atttgctgtt attaatgtct ctataggtga ttatttccct gtagagatta
67741 tagatgtaat taatgaattc aaacctgcag gtgtaactct atatgtcact tatgatgggg
67801 cttctactat tagaggtgga gcaattatta agtggttaga tgggttacct aaaatagaaa
67861 cataccaaga gtttgataga tttacaggtt atgatgatac attctatggt catattaata
67921 tgaatcaaag taaagatact gataacagtt catcagatat ttttaaaaca aaccatagct
67981 taattaatag tttagatgtt ttaacaggtt catctagtgt agggagacag tatattaact
68041 acggatatgt aacatcatat gtttataatc caggtatgac atcttctgta aatcaaataa
68101 gcgctagtac agaaggtaga ggtcaagaag tacctactga ctattatatg tatactagta
68161 ctaagaataa caatacagta gaacttagta tgcaaactac ttccggtgtg tcttatttat
68221 ataataactt taattttagg gactatatga gtaaatatag acctcaagta gatttacaat
68281 ctgatgaggc tagaagaatt gtatctgatt atataaaaga attaagtatt gattactatc
68341 ttagtgctgt gatacctcct gatgaaagta tagaaattaa actacaagtt tatgattttt
68401 ctattaatag atggcttaca gtatcaatta ataatttatc tttctatgaa aaaaatatcg
68461 ggagcaatat aggatatata aaagattatc taaacagtga attaaatatg tttactaggt
68521 tagagataaa tgcaggtaaa agagattcag tagatattaa agttaattac ttagatttaa
68581 tgtttatta ctatgaacga ggtatttata caataaaacc gtataaagca ttaatagaaa
68641 attatttaga tatatctaga gagacttatg tagaagcatt taaaatagca tcattatcta
68701 atggagatat tataactaaa acaggttttc agcctatagg gtatttaaaa ctagttggta
68761 attatgaaaa tacaatacct agcacaataa atatagtagc taaagataca gataataacc
68821 ctagaatc taatgaatta gatgtatata atacagtaga gaatagaaat ttattacaat
68881 cttataaagg tgtaaatacg atagctagag aaataaacttc tacaaaagag tttactgtat
68941 caggatgggc taaagagata tactcaacta atatctttc taaagtatta aaaccaggta
69001 aagtgtatac gttatctttt gatatggaaa taacaggtaa tgacccaact cttaaatctt
69061 attctgataa tcatggtata tatttataca gtaatactaa gggaattgtt gttaatggtg
69121 ttaaatctat ggaacgtact ataggtaaca aagtatccgt aactcaaact tttacagccc
69181 ctactattac tgaccataga ttactaatat atactggaag atatacatct gatggtaaag
69241 catcaactcc tccagtgttc tttaatacag ttaaaattac ggaattaaaa ttgactgagg
69301 gttcttctaa gctagagtac tcacctgctc cggaagataa acctaacgta atagaaaaag
69361 gaattaaatt taataatatc ctaactaata tacagacttt aagtattaat tcggatacta
69421 tcttaaaaaa tgtaaacttta tattattctt actatggtga tagttgggta gaactaaaga
69481 ctctaggaaa tattagtact ggagaaacaa cagaaaccaa taacttaata gatttatatg
69541 gattacagac agtagattct tctaatataa atccaatgtc taaagtatca ttacgttcca
69601 tttggaatgt taagctaggt gaattgaaca atcaagaagg ttctttatct aatatgccta
69661 atgattactt taatgctgta tggcaggata tagataaatt atcagatatt gagctaggtt
69721 ctatgagaat ggttaaagac actgagggcg gagtattcga tggagctaca ggtgaaatta
69781 ttaaggctac tctattaat gtcggtgctt atactgattt agatatgtta gcctatactt
69841 tgactaatta tactgaaccg ttaacgttag gctctagtcg attaataagt gagctaaaag
69901 aagaactact aacatcagaa tcatttaatg tcgataatag aattaaagta attgactcaa
69961 tatatgagga gttaccaaat acaagcatta ttaaaaatgg atttgttgaa agagaagtta
70021 caggttctaa atatttagat tacggtttat atgagcctat agaagatggt actagatata
70081 aacttattgt cgaaggagaa tttaaagata atatagaatt tatatcttta tacaattcta
70141 accctaactt taatgaaaca tttatatatc catcagagat aattaatgga gttgctgaaa
70201 aagaatttat tgcaaaacca tctactgaag acaaaccaag gttaaataca gatgttagaa
70261 tatatatacg accttatgat tcaactatct ctaaagtaag aagagtagaa ttaaggaaag

```
70321 tttaataaat aagttgacag aaagttaata atatggtata cttataaagt aatatttagt
70381 gggtatacca tgttatatta ataaagaaaa caacagatga aaggaattaa aaaatatggc
70441 aattgcaacg tataattctc atgttgagtt agcaaaatat ctagttagta aagctgattc
70501 agtttactta acaattggaa agagcacacc gtggtctaat gaaacaaacc caccgcaacc
70561 tgatgaaaat gcaacagtat tacaggaggt tattggatat aaaaaagcta ctaaagttac
70621 tttagttaga ccttctaaat cacctgaaga tgataataag aatttaattt cttatggtaa
70681 taaatcgtgg gtagaagtaa cacctgaaaa tgctaaagct gaaggagcta aatgggttta
70741 cttagaaagt agtattgttg gtgacgaact acctcttgga acatatagac aagtaggatt
70801 tgttatggac ttagtagcaa aaagtggtat tagtaaaattt aactagtac ctagtgaagt
70861 agaatcaact ggaacattat tattctttga taataaacaa ttccaaaata gaagtgagca
70921 gacaactgct aaagaaagat ttattgtaga agtttaaaga aagggagata attctaaatg
70981 gcaattaatt ttaaaggttc accttattta gatagatttg acccgtctaa agatagaaca
71041 aaagtattat ttaatcctga tagacctcta caacaggcag aattaaatga aatgcagtct
71101 atagaccaat attatttaaa aaatctagga gacgctattt ttaaagacgg agataaacaa
71161 tcagggcttg gattcacatt gtctgaagat aatgtattga cagtaaaatcc tggttatgta
71221 tatatcaatg gtaaaataag atattacgat aatgacgatt cagttaaaat aactggcgta
71281 ggtaaagaaa ctattggtat taaattaaca gaacgtattg ttacacctga tgaagatgct
71341 agcctattag accaaactag tggagtacca agttacttct ctaaaggtgc agatagatta
71401 gaagaaaaga tgtcattaac agttaatgac ccgacatcag caactattta tactttcatg
71461 gatggggatt tatatattca atcaactaat gctgagatgg ataaaatcaa caaagtatta
71521 gctgaacgta cttatgatga gtcaggttca tataaagtaa atggttttga acatatttca
71581 gaaggtaatg ctgaagatga tgaccacgtt tctgtagttg tagatgcagg taaagcctat
71641 gtaaaaggtt ttaaagtaga caaaccccgta tcaacaagaa ttagtgtacc taaatcttat
71701 gacttaggaa cagcagaaaa tgaaagtact atctttaata agtctaataa ctctattagt
71761 ttagctaata gccctgtaaa agaaattaga cgtgttacag gtcaagtact tattgaaaaa
71821 gaacgagtta caagaggagc tcaaggtgat ggtcaagatt ttctttcaaa taatacagca
71881 tttgaaattg taaaagtttg gactgaaaca agccctggag ttactacaaa agagtataaa
71941 caaggagaag acttcagatt aacagatggt caaacaattg attggtcacc tcaaggtcaa
72001 gaaccttcag gaggtacttc atactacgtt tcttataaat ataacaaacg tatggaagcc
72061 ggtaaggatt atgaagtaac aactcaaggt gaagggttaa gtaagaaatg gtacattaac
72121 tttacacctt caaatggtgc taaacctatt gaccaaacag tagtattagt agactatact
72181 tactacttgg ctcgtaaaga ttcagtgttt attaataagt atggtgatat tgcaatatta
72241 cctggtgaac ctaatattat gagattagtt acaccaccat taaacacaga ccctgagaat
72301 ttacaattag gtacagttac agtattacct gattcagatg aagccgtatg tatttcattt
72361 gcaatcacta gattgtctat ggaagactta cagaaagtta aaacaagagt agataactta
72421 gagtataacc aagcagtaaa tgctctagat gatggtgcta tggaaggaca gaaccctcta
72481 acattacgtt cagtattcag tgaaggtttc attagtcttg acaaagcaga cattacacat
72541 cctgacttcg gaattgtatt tagttttgaa gatgcagaag ctactctagc ttatacagaa
72601 gcagttaacc aacctaagat tattccagga gatacaacag ctcatatttg gggtagatta
72661 attcagcac catttactga ggaacgtaca atctaccaag gtcaagcatc agaaacatta
72721 aatgttaacc cttataatat tcctaacaaa caaggtgtgt taaaattaac acctagtgag
72781 gataactgga ttgatactga aaatgttaca atcactgaac aaaaaactaa aaaagtaact
72841 atgaaacgat tttggagaca taatgaaagt tactatggtg agactgagca ttacttgtat
72901 tctaacttac agttagatgc aggacaaaag tggaaaggtg aaacttacgc ttatgataga
72961 gagcatggtc gtaccggtac tttattggaa tcaggaggac aacgtactct agaagaaatg
73021 attgaattca ttagaatcag agatgtatcc ttcgaagtta aaggactaaa ccctaatgat
73081 aataatttat attattatt tgatggagta agatgtgcta taacacctgc aactggctat
73141 agaaaagctc tgaagatgg tacgataatg acagatgcta aaggaacagc taaggtaag
73201 tttactattc ctgcaggtat tcgttgtggt aaccgagaag ttacacttaa gaatgctaac
73261 tctacaagtg ctacaactta cacagcccaa ggacgtaaaa aaaccgctca agatattatt
73321 atcagaactc gtgtaacagt aaacttagta gacccgttag cacaatcatt ccaatatgat
73381 gagaatagaa ctatatcatc attaggatta tactttgctt ctaaaggtga taaacaatct
73441 aatgttgtta tccaaattag aggtatgggt gaccaaggtt atcctaataa aacaatctat
73501 gcagaaacag ttatgaatgc tgatgatatt aaagtatcta ataatgctag tgctgaaact
73561 agatatact ttgatgaccc tatgatggct gaaggcggta aggagtacgc tattgttatt
73621 attactgaga acagtgatta tacaatgtgg gtaggtacta gaactaagcc taaaattgat
```

```
73681 aaacctaatg aggttatttc aggtaatcca tacctacaag gtgtattatt cagttcatca
73741 aacgcatcaa catggactcc tcaccaaaac tctgacctta aatttggtat ttatacttct
73801 aaatttaatg agacagcaac gattgaattc gaaccaatta aagatgtatc agcggataga
73861 atagttctta tgtctacgta cttaactcct gagagaacag gatgtacgtg ggaaatgaaa
73921 ttaattctag atgatatggc atcttctaca acattcgacc aattgaaatg ggagcctatc
73981 ggtaactatc aagacttaga tgttttaggt ctagcaagac aagttaagtt aagagcaact
74041 ttcgaatcta atagatatat ctcaccatta atgagctcta gtgatttaac attcactaca
74101 ttcttaacag agttaacagg ttcatatgtt ggtagagcta ttgatatgac agaggctcct
74161 tacaatacag taagatttag ttatgaagct ttcttaccta aaggtactaa agttgttcct
74221 aagtattctg cggatgatgg aaaaacttgg aaaacattta ctaaatcccc tacaactact
74281 agagccaata atgagtttac acgctatgtc attgacgaga aagtaaaatc atcaggaaca
74341 aatactaaac tacaagttag attagattta tcaactgaaa atagcttttt acgtcctcgt
74401 gttcgtagac ttatggttac tactagggat gaataaaacta gaggggttga ttgaccccctc
74461 tttatttaat aaggagagat ttatatgcct agagaagtta gagaccctta ttctcaagct
74521 aaattattta tacctacagt tgaggaaaaa tcaattaagg aattagaaaa aacatacaaa
74581 gaaaaaattg atgaagctac taagttaatc aatgaattaa agaaagagag aggagaaaaa
74641 tagatggcat ttaactacac gcctcttact gaaacacaga agttaaaga tatgtatcct
74701 aaagttaatg atataggtaa ctttttaaaa acagaagtta accttagtga tgtaaaacag
74761 atatcacaac ccgactttaa taatattta gcatctatac ctgatagtgg taactattat
74821 gtaactaatt caaaaggtgc tcctagtgga gaagctacag caggatttgt aagattggat
74881 aaaagaaatg taaattatta taaaatttac tattcaccat atagcagtaa caaaatgtat
74941 atcaagactt atgctaatgg tactgtatat gattggatta gttttaaatt agatgaaggt
75001 agcttataca atgaaggtaa tactttgaat gtaaaggaac ttactgaatc cacaactcaa
75061 tatgcaacac tagttaatcc tccaaaagag aacttaaata caggttgggt taattacaaa
75121 gaaagtaaaa atggtgtttc ttctttagta gaatttaacc cggttaactc cacttcaact
75181 tttaagatga taagaaagtt accagtacaa gaacaaaagc ctaacttatt gaaagatagt
75241 ttattgttt atcctgaaac tagctattct aatattaaaa cagataactg ggatacgcct
75301 ccatttggg gatattcttc taatagtggt cgttcaggag ttagattag aggagagaat
75361 acagtacaga tagatgatgg gtctgatacg taccccttcag tagtttctaa taggttaaaa
75421 atgggtaaag aacttctgt aggtgatact gtaacggtat cagtatatgc taaaattaat
75481 gaccctgctt tacttaaaga taacttagtt tactttgaat tagcaggata cgatactgta
75541 gatgatacta gtaaaaatcc ttatacagga ggacgtagag aaaataacagc aagtgagata
75601 acaactgagt ggaaaaaata ctctttcaca ttcactatac ctgaaaatac aatcggagca
75661 tcaggcgtta aagttaatta cgtatctta ctactaagaa tgaattgttc atctagtaaa
75721 ggtaatggtg ctgtagtata ctatgcctta cctaaattag aaaaatcatc taaagttaca
75781 ccatttatta cacatgaaaa tgatgttcgt aaatatgatg agatttggtc taattggcaa
75841 gaagttatta gtaaagatga attaaaaggt cactcccctg tagatattga atataatgat
75901 tattttaaat atcagtggtg gaaatctgaa gttaatgaaa agagtttaaa agatttagct
75961 atgacagtac ctcaaggata tcatacattt tattgtcaag gctctattgc cgggacgcct
76021 aagggacgtt ctattagagg aaccattcag gtagattatg acaaaggtga cccatataga
76081 gctaataagt ttgttaaatt attgtttact gacacagagg gtattcctta cacattatat
76141 tatggtggtt ataaccaggg ttggaaaccc ttaaagcaat cagaaacttc tactttacta
76201 tggaaaggta cttagatttt tgggtctacg gaagctgtta acttaaatga ctcattagat
76261 aattacgatt taattgaggt aacttattgg actcgttcag caggacattt ttctacaaaa
76321 agattagata taaaaaatac atcaaaatta ctgtatatta gagatttaa tatttcaaat
76381 gatagtacag gttctagtgt agacttttt gaagggtatt gcactttcc tactagaaca
76441 tcagtacaac ctggtatggt aaaatctata acttagacg ggtctacaaa tacaacaaaa
76501 gtagcatcat ggaatgaaaa ggaacgtata aaggtataca atattatggg aattaataga
76561 ggataaagaa aggtggaata aaaaactat ggctgttaaa tatgatatag gtaataatga
76621 gatagtatta catttaagag aaggtaaata tatacacaggg tttacaacag taggagggta
76681 tgataaggag ttaggacaag taaaagttaa tagagaaatc ttacctgctt acttctttga
76741 taattttgcc tatgaaagat atttgtatta tagtaaacct gaagaggtta tagaaaataa
76801 aaactatgta ccaccacaaa tcaatgatga tgatgaggaa tccaacaaa ttactgtacc
76861 taaagaacaa tatgatagtt taaaagaaga actagagctt atgagaaaac aacaagaagc
76921 tatgatggaa atgcttcaaa agctcttagg tcaaaagggg taattataaa tggcattaaa
76981 ttttactaca ataacggaaa acaatgttat tagagacctg actactcagg tcaataacat
```

```
77041 tggagaagaa ttaacaaaag aaagaaatat atttgacatt accgatgatt tagtttataa
77101 tttaataaa tcacagaaaa ttaaactaac tgatgataaa ggattaacta aatcttatgg
77161 aaacataaca gcccttagag atataaaaga acctggttat tactatatag gtgctagaac
77221 attagcaaca ttattagata gacctgatat ggaatctctt gatgttgttt tacatgtagt
77281 accctctgat acttctagta aggtagttca acatttatat acactatcta ctaacaataa
77341 ccaaattaaa atgttatata gatttgtctc aggaaactct agttcagaat ggcaatttat
77401 tcaaggatta cctagtaata aaaatgctgt tatatcagga actaatattt tagatatagc
77461 ttcaccaggt gtttactttg ttatgggaat gacaggagga atgcctagtg gagtaagctc
77521 cggatttta gacttaagtg tagatgctaa tgataataga ttagctagac taactgatgc
77581 tgaaaccggt aaagaatata ctagcattaa gaaacctaca ggaacataca cagcctggaa
77641 aaaagaattt gagccaaaag atatggagaa atatctacta agtagtatta gagacgatgg
77701 tagtgcatca ttcccactcc tagtttatac tagtgatagt aaaacatttc aacaagctat
77761 tatagaccat atagatagaa caggtcaaac aacctttact ttctatgttc aaggcggtgt
77821 atccggttcc cctatgtcga atagttgtcg agggttattc atgtcagaca cacctaatac
77881 ttctagttta catggtgttt acaatgctat aggtacagat ggtagaaatg taacaggttc
77941 agtggtaggt agtaattgga cttcaccaaa aacatcccct tctcataaag aattatggac
78001 aggagcacaa tcattcttat ctacaggaac tactaagaat ttatcagatg atattagtaa
78061 ctactcttat gtagaagttt atactacaca taagacaaca gagaagacta aaggtaatga
78121 caatacagga actatatgtc ataagttta tttagatggt agtggaactt acgttgttc
78181 aggtacattt gttccggggg atagaaccga tacaaaaccc cctatcacgg agttttatag
78241 agtaggtgta tcttttaaag gtctacatg gactcttgta gatagtgcag tacaaaatag
78301 taaaactcaa tacgttacaa gaattatagg tattaatatg ccatagacta ggagaaattt
78361 cctagtcttt tttttcttg acttgaaaag gattctgtgg tatactataa ctcgtgtaag
78421 gatataagga gattaaaatg agattaagaa ttaagaactt atatacctat gtagaatttg
78481 aggaggatga taaatactta aaagatatat tttaaagag agtccatacg actataggag
78541 caagacaaga aggatttcag tacagccctg cgtacaaaag aggtagttgg gatggttatg
78601 tagattttta tgtttatgag gaagataaat tccccactgg actttattt aaaattgagt
78661 tattattagg tgagctacaa tcaaggtata atttccagtt tgaaacaatt gatgagcgtg
78721 atgaaagttt cttatctgaa gaagatatt atgatgagat aacattgctt gataataatg
78781 tcggtcaaat tacccttaaga gattaccaat atgaagcagt gtacaatagc ttaacatttt
78841 acaatggtat tgctcactta gctactaatg gtggtaaaac tgaggttgct agtggtatta
78901 tagaccaatt attacctcaa ttagaaaaag gtgagagagt agcattcttc acaggctcta
78961 cggagatatt ccatcagtct gcagataggc tccaagagcg tttaaatatt cctattggta
79021 aagtaggtgc aggtaagttt gatgttaagc aggttacagt tgtaatgata cctactttaa
79081 atgcaaacct taaagaccca acacaagggg taaaggttac gcctaaacaa aatattagta
79141 aaaagattgc tcaagagata ttacctaaat ttgaaggtgg aacaaatcaa aagaaattac
79201 taaaagtatt acttgataac acaacaccta aaacaaaagt agaacaaaat gtattaagtg
79261 ccttagagat aatttaccaa aatagtaaga cagatgcaga agttttatta aacttaagaa
79321 atcataatgc acattttcaa aaaattgtta gagaaaagaa cgaaaagaaa tatgataaat
79381 atcaagatat gagagatttt ttagactcag ttacagttat gatagttgat gaggcacacc
79441 attctaaatc tgattcttgg tacaataatt taatgacatg tgaaaaagct ttatatcgaa
79501 ttgcattaac agggtctata gataaaaaag atgaattact ttggatgaga ttgcaggcgc
79561 tattcggtaa tgttattgca cgaactacta ataagttttt aattgatgaa ggtcattctg
79621 ctagaccaac aataaatatt atacctgtag ctaatcctaa tgacatagat agaattgatg
79681 attatagga agcttacgat aaaggtataa caaataatga tttaggaat aaacttattg
79741 caaaactaac agaaaagtgg tataatcaag ataaaggtac attgattatt gtaaacttca
79801 ttgaacatgg agacacaata tcagaaatgt taaatgattt agatgtagag cattacttct
79861 tacatggaga aatagactct gaaactagga gagaaaaatt aaacgatatg agaagtggta
79921 agcttaaagt aatgatagct acatcactta ttgatgaggg tgtagatata tcaggtatta
79981 atgcactaat attaggtgca ggaggtaagt cattaagaca aacattgcaa cgtattggtc
80041 gtgctttacg taagaaaaaa gacgataata caacacaaat atttgatttt aatgatatga
80101 caatagatt tttatatact catgctaatg agcgtggaa aatttatgaa gaggaagatt
80161 tgaaataaa agacttagga aaataggagg gtaagagatg gcaacaaaaa cacaaagaaa
80221 gctataccaa tatctagagg aaaatgctac agaaaataaa tttcatattt ctactaagaa
80281 agagctagca gattctctag gtgtttccat ctctgcttta tccaataacc ttaaaagtt
80341 agaagaagaa aataaagtcg ttactgtttc taaaagagga aaaaacggcg gggtaataat
```

```
80401 aactttagtt agagagtatg acacagaaga attgaaagaa ttcaataatt ctacagataa
80461 tattattact tccgatttac agtatgctaa ggcattaaga gaaaagcact tcccttctta
80521 tagatatgag agaaaagaac aacgtagacg tactaagata gaaatggcac aatacaatgc
80581 cattaaggat gagaagagaa gaattatagc agatatgaat ttctattcag aaggtcttcc
80641 ttatccttct aaagatattt ttaatatgtc ctatgacccg gaagggtttt ataaagcgta
80701 catcttatgt aagttatacg accaatatgc tatttctcat atggatgcta aacatacaag
80761 tcatcttaaa gcaatgagta aggcaacaac taaagatgaa tacgactacc atcaacatat
80821 gtctgaatac tatagaaata aaatgattca aaatttacct agaaatagcg ttagtgataa
80881 tttctttggt agtaaaatgt ttaatacttt ttataatttt tatttaaaaa taaaagataa
80941 aaatattaat gtatttaagt atatgcaaaa tgtatttaaa aatgtaacat tttattacga
81001 gaacggtatg caacctaatc caatacct tc tcctaacttc tttagctcag ataagtattt
81061 taaaaactat aataattata ttaaaggaat aaaaaaaggt gttaacagta ctaatagaca
81121 cctaggtgat acagacagca tcattaattc atcagactat gtgaaaaacc ctgctgtatt
81181 acatctacac caactatata ctacaggatt aaattctact ttacatgata ttgatactat
81241 gtttgaacaa gccttagacc ttgaaaatgc ctcctatgga ttatttggag atatgaaaca
81301 tattatttta ctacagtata attctatgat tgaagaagaa attaagaatt tacctagaga
81361 agaaaaggat attattaata aatagtaaa acaatgcata attaatgatt attcaccaac
81421 aagtatttca ccttctgcaa ggttatcaat gttactatg cagaaagagc atatagttta
81481 caataagcag ttaaataaag gaatcaagag agaggattta ttaccattaa gtctaggagg
81541 tatagtgaat aaagatttat tgagtggtat ggatatacaa aacttagaac agaatggtaa
81601 tgaataccta tatgtgagac aacatacttc aacttattat atattaagaa tgtttggtga
81661 ctatttaggg tatgaggtaa acttaagaga agtaaaatat attgtagaga aatataattt
81721 aattgataaa ataccattga caaagagggg tatgttggat tataataaac ttatacattt
81781 agtagaggaa gaggttaata actatgagta agaagataaa ggagcttatc cttcataaat
81841 caatgaagga tatacatttt gcaagagaag tattagataa cttacctaag aatctatttt
81901 cagcagagtc tgaggacatg ggttacttat ttacagctat aaagagaaca gcacatattt
81961 ccgataagat gtcaaatgaa gcattagcaa ttaaagtaga acagcttatg ggtaataata
82021 aggaagatga agagaaagta accaagacat taacttactt agaagatttta tataaagtag
82081 acgttaatga aaaagatgaa tctgttaatt atgaaataga gaagtatatt aaaacagaaa
82141 tgtcaaaaga agttttagtt aaatttattg cagaaaataa acaagaagac tctgataatc
82201 tacatgaact tgtagacaaa ctaaagcaaa tagaagtaag tgacatctca ggaggtaatg
82261 gggagtttat tgacttcttc gaagatacag aaaagaaaca agaactattg agtaatttag
82321 ctacaaataa attctctact ggattactt ctattgacaa ccatattgaa ggtggtatag
82381 caagaggaga ggttggatta atcatagctc ctaccggtag aggtaaatca ttaatggctt
82441 caaacttagc taagaattat gttaaaagtg gattaagtgt tttatatatt gccttagagg
82501 aaaaaatgga tagaatggtt ttgcgtgctg agcaacaaat ggcaggagca gaaaagagtc
82561 aaattgtaaa tcaggatatg tcttttaaata ataaagttta tgatgcaata caaaatcatt
82621 atcagaagaa tagaaagtta ttaggtgact tttatatttc taaacatatg ccaggtgaag
82681 ttacaccaaa ccaattagaa caaattattg tcaatacaac aattaagaag gataaaaata
82741 ttgatgttgt tattattgac tatcctcact taatgagaaa tccttatgct aaatatcatt
82801 cagaatcaga tgcaggaggg aaattgtttg aagatattcg tagattatca cagcaatatg
82861 gatttgtttg ttggacgtta gctcaaacta accgtggtgc ttatggttca gatgttatta
82921 caagtgagca tgtagaaggt tctcgtaaga ttgtcaatgc tgttgagggtg tctttagcag
82981 taaaccaaaa agatgaagaa ttcaagagcg gtttcttaag attgtatttta gataaaattc
83041 gtaatagctc taacacagga gaacgatttg ttaatcttaa agtagaacca actaagatga
83101 ttgtaagaga tgaaacaccct gaagaaaaac aagagcatat acaattgcta tcagataatg
83161 gaaaagaaga cacaagtaaa tttcaaaata aagataataa aatagaagct ataaataaca
83221 cattcggagg attaccggga gtttaatttt ttaaaatata ccacttgaca ttttatatgt
83281 taggtggtat aattatttta taaagaataa aggagagatt aataatgaaa tttgtattct
83341 ttacagatat ccacttcac ttatttacta actatgctaa acctgatgag cagtatgtga
83401 atgatagatt tagagaacag atacaagctt tacagaaaat gtttgatatt gcaagagaag
83461 aggatgcaac agttatattt ggtggggatt tattccacaa acgtaacgca gtagatacta
83521 gagtatataa taaggtattt gaaacattcc aacttaatag agatatagaa gtactaatgt
83581 taagaggtaa tcatgattca gttacaaata gtttatatac agattctagt atagaacctt
83641 tcggttactt acctaatgta gaggtttgta aaaaccttga tactttaggg ttttaggag
83701 aagaacagga tattaatatt gttatggctc cttatggaga cgagactgaa gaaattaaag
```

Figure 17 (contd.)

```
83761 agtttattaa aaataaatat gtagaagata gagtaaatat cttagtaggt catttaggtg
83821 tagaaggctc tttgactgga aaagggtctc atagattaga aggggcattt ggataccagg
83881 atttattacc tgataaatat gatttcattt tactaggtca ttatcaccgt agacaatatt
83941 tccaaaatcc gaatcatttt tatggtggtt cattaatgca acaatcattt tctgatgagc
84001 aagaagctaa tggtgttcat ttaatagata cagaaaaaat gactacagaa ttcatcccaa
84061 tccatacacg tagatttatt actattcaag gagaagatat tcctgagaac tttgaacagc
84121 taatcgagga agataatttt attagggtta tcggtacagc aaatcatgct aaggtttag
84181 aaatggatga cagtatgaaa gataagaatg ttgaagttca aattaaaaaa gagtatactg
84241 tagagaaacg tattgatagt gatgtgtctg atgaccettt aacaattgct agtacctatg
84301 ctaaacaata ctcacctgaa tcagaacaag aaatacttga gtgtttgaag gaggttttat
84361 aatgaaaaaa tatagagaat atctaaataa gacagatgca gaaaatttag cagaggattg
84421 ggagaaagta accgaagatt tatggaaagt gtttaaagat atgaaaccta aaattaatac
84481 attagatatc agtaatgtag taagtaaaga cttagataaa agtaaaccta ttttacaatt
84541 ccaagattca gatggagtaa tagagaaatat ttgtaatgtt gaaggtttag aagatggtct
84601 aagtaaaatg aaaaagattt ttgatgatag taattttgaa aagcattatt acaataagt
84661 agtagaccat gatgagtatt actggattga ttatggctct catcattgtt tctttagagt
84721 tacgaaaggg gataagtaat ggttgtattt aaacaagtag aagttaataa ttttttagca
84781 attaaagaag ctacgctaga gttagacaat agaggattaa ttctaattga aggtgagaat
84841 aaatctaatg agtcatttca ttcaaacggc tcaggaaaat caactttaat atctgccatt
84901 acttacgctt tatatggtaa aactgaaaaa ggactaaaag cagatgatgt agtaaataat
84961 attgagaaga aaaatacatc tgttaaactt aagtttgata ttggggaaga tagttattta
85021 attgaacgtt atcgtaaaga taaagaaat aagaataaag taaaattatt cgttaatgaa
85081 aaagagatta caggttcaac aaatgacgtt accgataaac aaatacaaga tttatttggt
85141 attgagtttta atacttacgt taatgccatc atgtatggtc aaggagatat ccctatgttc
85201 tctcaagcaa cagataaagg taagaaagaa attcttgaat ctattactaa gacagacgta
85261 tataaacaag cacaagatgt agcaaaagag aaagttaaag aagtggaaga acaacaaaat
85321 aacataagac aggaaatcta taaactaggt tatcagttat cgacaaaaga tgagtacttt
85381 caaagagaaa tagagcagta caatcaatat aaagaacaat tggttcagat agaaaacagt
85441 aataaggaaa aagatagatt aagagaacaa gaggagaagc aaatagaagc tcaaatagag
85501 caactagctt cacagatacc aacaatacct gaagatgaat ttaagcactc agaggagtat
85561 aataaagcct ctcaaagcct agatttactt tctaataaat taacggagtt aaatcaagtt
85621 tactcagagt ataataccaa agaacaagta ctaaaatctg aaatagctac attaagcaat
85681 agtctaaatc agttagatac aaatgaccat tgtcctgttt gtggctcccc tatagataat
85741 tctcataaat taaaagaaca ggaaaatatc aataatcaga ttgagaataa gaaacaagag
85801 attactagtg tattagaaat gaaagatacg tataaagaag ctattgataa agtaaaagat
85861 aaatcacaag aaattaaaga taaatgtca caggaagacc aacaagaacg agagcacaat
85921 aataagatta acagcataat tcaagaggct tctaggatta aatcagacat tagttcatta
85981 gagaataata aaacgtattt aaaagttaaa tatcaacatc aatctgttca aggattagag
86041 agagaagaac caagtaaaga aaaacatgag gaagataaga aagaattaca agaatctatt
86101 gacaaacatg aagagaatat agtacaatta gaaactaaga aaggtaaata tcagcaagct
86161 gtagatgctt ttagtaataa aggtatacgt tcagtagtgt tagactttat tacaccattc
86221 ttaaatgaaa aagcaaatga gtaccttcaa actttatcag gttcagatat tgaaatagag
86281 ttccaaactc aagtgaagaa tgctaaagga gaactaaaag ataagtttga tgttattgtt
86341 aagaatagca agggcggagg ttcgtacaaa tccaattcag caggagaaca aaaacgtatt
86401 gatttagcaa ttagttttgc aattcaggat ttaattatga gtaaagatga gatatctacg
86461 aatattgcac tttacgatga gtgttttgat ggattagata ctatcggttg tgaaaacgtg
86521 attaaattat taaaagatag acttaataca gtaggaacaa tatttgtaat tactcataat
86581 accgagctta aaccactgtt tgaacaaaca attaaaaatcg taaaagaaaa tggagtatca
86641 aaactggagg aaaaataatg aaattaaaga tttagataa agataatgca acacttaatg
86701 tgtttcatcg taataaggag cacaaaacaa tagataatgt accaactgct aacttagttg
86761 attggtaccc tctaagtaat gcttatgagt acaagttaag tagaacggg gaatacttag
86821 aattaaaaag attacgttct actttaccttcatcttatgg tttagatgat ataaccaag
86881 atattattag agataatac catagatgta aaataggtta ttggtacaac cctgcagtac
86941 gcaaagataa tttaaagatt atagagaaag ctaaacaata tggattacct attataacag
87001 aagatatga tgctaatact gtagagcaag gatttagaga tattggagtt atattccaaa
87061 gtcttaaaac tattgttgtt actagatacc tagaaggtaa aacagaagaa gaattaagaa
```

Figure 17 (contd.)

```
87121 tatttaacat gaaatcagaa gagtcacaac tgaatgaagc acttaaagag agtgatttt
87181 ctgtagattt aacttatagt gacttaggac aaatttataa tatgttgtta ttaatgaaaa
87241 aaattagtaa atagtaagga aggatattat gaggtttgaa gactttttaa cccaagaatt
87301 aggagaacca aaagaaaata ctataggtga gctaagatac tgttgtccgt tttgtggaga
87361 aaaaagttat aagttctatg ttaagcaagc cctagactct agtaatggtc agtatcattg
87421 taaaaaatgt gatgaatcag gtaaccctat tacattatg aagacttatt ataacattac
87481 aggtaaacaa gctttgatt tattagagtc taagaatata gatatagaga gagcccctt
87541 acttacgacc aataataagg atttgacaga atcagagaaa cttatattaa tgcttagagg
87601 tgtgcaccaa gataaaggaa atactagtat taaacctcct agattacctg aagggtataa
87661 attattaaaa gataaacttaa ataataaaga gattataccc ttttaaaat acttaaaagg
87721 tagaggtata acttagaac aaatcattaa taacaatata ggttatgtta ttaatgggag
87781 cttttataaa gttgacgggg aatccaaagt atcattaagg aatagtatta tattttttac
87841 ttatgataat gatggaaact accagtactg gaatacaaga agtatagaga agaaccctta
87901 tattaaatct attaatgctc ctgctaaaca agatgaagta gggagaaaag atgtcatatt
87961 taatttgaat atagcaagaa agaaaaagtt cttagttata actgaggtg tatttgatgc
88021 tttaaccttc catgagtatg gagtagcaac attaggtaaa caagtaaccg agaatcaaat
88081 aaaaaaaata attgattatg ttagtataga tacatcaata tatattatgt tagacactga
88141 tgcactagat aataatatag acttagctta taagttaaaa acacatttta ataaagttta
88201 ctttgtacct catggtgatg aagatgcaaa tgatatggggg acaaggaaag cctttgagtt
88261 attaaaacag aaccgggtgt tagtaacacc tgaaagtata cagagttaca aaatacaaca
88321 aaaacttaaa cttttaggctt gaccttagag aagttttatg ttatactagt aattaagtaa
88381 ttaataaagg agaaaaaaaa taatgtcaaa taataaaaaa gatattttag aatttgtaga
88441 tgaatacatt acagctttaa gagttggtaa tgagcaacga caacatcaat tagaagaaat
88501 gggtaaagaa gaaacagcaa cattaacaga tgtagctaaa gctattacta acctatgtt
88561 aggtgttaat gagcagatga cagacttaga atataataat gagttaaact taaatatttt
88621 aattgacgct ttatataaag cagagcttat taatgaagat gtattagact acattcaaga
88681 atcaattgat aaatcacaag aagaacctaa aaatgaagaa gaaaaaggag aacaagaata
88741 atggaaaaaa atattagcac acacacaaaa ggtattagtc aagcagacat ggagaaatgg
88801 attgaagctg cagtacaagg aactgttgat ggtaaacaag ttgatgagaa aacagctaaa
88861 caattagata gaattggttc acgtagtgtt tctttagaag aagcaactcg tattgctaaa
88921 gttcttaatg ctgtaacagc tcaagaggtt acaggagact ttaatgatgc atttaatgca
88981 attgacttaa tgatgattat catggaagat gagttaggag taactcaaga aaaagtaggg
89041 aaagctaaag ataaactaaa tgaaaaacga gaagcttacc taaaagagaa acaagaagaa
89101 ttacgtcaaa aacaacaaga agaggcacag aaaaaaaactg aatctgacag caatgaaaaa
89161 gtaattcagt tgaagaaaaa tgacgaacag taagaaaaaa ggggatacat tcgaacgtaa
89221 aatagctaaa gaattaactt cttggtgggg ataccaattc aataggtctc ctcaatcagg
89281 tggtgcttca tggggtaaag ataataatgc tgtcggagat atagtagtac ctcaggaagc
89341 taatttttcct ttagtagtag aatgtaaaca tagagaagaa tggactatag ataatgttct
89401 tctaaacaac agagagccac atacatggtg ggagcaagtc attaatgata gtagcaaggt
89461 gaataagaca ccttgcttaa tatttactag aaatagagct cagagttatg ttgcttacc
89521 ttatgatgaa aaagtatatg aagatttaag aaataatgaa tacctgtca tgagaacaga
89581 ttttattatt gataatatta gaaaagataa atttttttat gatgtcctta taactaccat
89641 gaatggggttg acctcattta caccttctta tattatatct tgctacgaca aaaaagatat
89701 aaaaccatac aagaaggtcg agtctaattt atctgaggta agtaagcatg aagatgaatt
89761 gattaatgac ctcttagtg atatataagg aaggtaagat aagtatgaca agtaaagaaa
89821 gaccattaat cgtatatttt tcaggtacag acaaacaga aagattagta aacaaaatta
89881 atattaataa ttcatttgaa acatttaggg ttaagagtgg aaaagaaaaa gtaaataaac
89941 cttttatact aataacacct acttataaga aaggtgcaat acctaaacaa atagaaagat
90001 tcctagaaat taatgggagc cctaaagaag ttattggtac aggaaataaa caatgggget
90061 ctaatttctg tggagcaagt aaaaagattt cagagatgtt taagattcct ttaattgcta
90121 aagtagagca atcaggacac tttaacgaga tacaaccaat attagaacac tttagtaata
90181 aatataaagt agcgtaaagg atgagagata tatggcaaca tatgaaaat ggattgagtt
90241 aaataatgaa ataactcaat tagatgacaa tggaaaaaat aaactctata aagaccaaga
90301 agctttagat gagtatttaa aatatattga agacaataca agaaagttta atagtgaagt
90361 agaaagaatt agagtattga caaaagaagg aacatatgat aaaatatttg acaacgttcc
90421 tgacactatt attgatgaaa tgactaagtt agcttacagt tttaattttta aattcccctag
```

Figure 17 (contd.)

```
90481 tttcatggca gggcaaaagt tttatgaatc ttacgcatca aaacagtatg atgaaaacaa
90541 aaaacctatt tttgttgaag actatgaaca acataatgtt cgagtagctt tatatttatt
90601 tcaaaatgac tatgtaaagg ctagagaatt actagtacaa cttatggagc aaacattcca
90661 accatctaca cctacgtata acaactcagg acaagctaat agaggtgaac taagctcatg
90721 ttatctattt gtagtagatg attcaattga gtctttaaac tttgttgaag atagtgtagc
90781 taatgctagt tctaatggtg gtggagttgc aattgattta actagaatta gacctaaagg
90841 agctccagta cgtaatagac ctaattcaag taaaggtgtt attgctttg ctaaagctat
90901 tgaacataaa gttagtattt atgaccaggg tggtgtaaga cagggtagtg gtgctgttta
90961 cctaaatata ttccacaatg atatcttgga tttattaagc tctaagaaaa tcaatgccag
91021 tgagtctgtt agactagata aattatctat tggtgttaca atccctaaca aatttatgga
91081 gttagttaaa gaaggtaaac ctttctatac ttttgatact tacgacatta ataaaatgta
91141 cggtaagtat ttagatgagc taaacattga tgaatggtat gataagttac taaataatga
91201 tagtatcggt aaagtaaaac atgatgctag agaagttatg acagacattg ctaaaacaca
91261 attagaatca gggtacccctt atgtattcta tattgataat gctaatgata atcacccatt
91321 gaaaaaccta ggtaaagtta aaatgagtaa cttatgtaca gaaatttcac aattacaaga
91381 ggtatcagaa atttatccgt attcttacag taatcagaat gttattaata gagatgttgt
91441 ttgcacatta ggttctctta acttggttaa tgtagttgaa aaaggtttat tgaatgaatc
91501 tgtagatatt ggtacaagag cattaacaaa agttactgat attatgatt taccttactt
91561 acctagtgtt caaaaagcaa atgatgatat tagagctatc ggtttaggtt caatgaattt
91621 acatggactt ttagctaaga atatgattag ttatggttct agagaagcat tagacctagt
91681 aaacagttta tatagtgcta ttaacttcca atctattaag acatctatgt taatgctaa
91741 agaaacagga aaaccattta aaggctttga gaagtccgat tacgctacag gtgaatactt
91801 tgtaagatac attagagaat ccaatcaacc taagacagat aaagctaaga agtcttaga
91861 taaggtttat attccaacac aagatgattg ggatgaatta gctaaagcag tgaaagtaca
91921 tggtttgtat aatggttacc gaaaagcaga agcacctact caatctatat cttatgtaca
91981 gaatgctaca agttctatta tgccagtacc tagtgctata gagaatagac aatatggaga
92041 tatggagaca tattacccaa tgccttacct aagtcctata actcagttct tctacgaagg
92101 agaaacagct tataagattg acaatagaacg tattattaat acaagcgcag ttgttcagaa
92161 acatacagac caagcagtgt ctacaatact ttatgtagag tcagaaatac ctactaataa
92221 actagtatca ttatactatt atgcttggga acaaggatta aaatcattat actatacacg
92281 ttcacgtaaa ctttctgtta ttgaatgtga aacatgttcg gtttagaaag gaaatagata
92341 tggatattac acaaaaagta aaacaacata ataaaaatgc tgtattaaaa gcaacaaact
92401 ggaatattga agatgacggg atgtctgata tttattggga gcaaggaatc tcccaatttt
92461 ggactcctga agagtttgat gtatcaagag atttaagttc ttggaatagt ttaactgaaa
92521 gtgaaaagaa cacttataag aaagtccttg cagggctcac agggctcgat acaaagcaag
92581 gaggagaagg tatgaactta gtatcctacc acgaaccaag acctaaatac caagctgtat
92641 ttgcgtttat gggtggtatg gaagagatac atgctaaatc gtatagtcat atctttacaa
92701 cattactaag taataaagaa acaagttatt tattagatac ttgggtagaa gaaaacgact
92761 ttttaaaagt aaaagctcag tttatcggat attactacga ccaactatta aaacctaatc
92821 ctactatatt tgatagatac atggctaaag tagctagtgc ctttttagaa agtgcattat
92881 tctactcagg attttattat cctttacttc ttgcaggaag aggtcagatg acacaatcag
92941 gagctattat tttataaaatt actcaagatg aagcttacca tggttcggca gtaggattaa
93001 cagctcaata tgattataat cttctaacag aagaagagaa aaaacaagca gataaagaaa
93061 cttatgaatt attagatatt ctttacacta atgaagtagc gtatacacat agtctatatg
93121 acccactaga attaagtgaa gacgtaatta actatgttca gtataatttt aatagagctc
93181 ttcaaaacct tggaagagag gactatttta tcctgaacc ttataaccct attgtagaaa
93241 atcaaactaa tgtgacagaa ttacgaaatg ttgatttctt tagtggtaaa gcagactatg
93301 aaaaatctac aaatatcaaa gatattaaag atgaagattt ctcattctta gatagtaaag
93361 aatacagtac tgccaaggaa ttcctataaa aaggagaaaa gatattatgg atagaaaaga
93421 agcaatggat ttactaagta aagcagaaat attatttaaa aaacatgatg agttttcatg
93481 tgtaagtgat atcaatgacc ctatgaagtt attcagtaac tctaaggatg ctaaagctga
93541 tgatacgtct aattctttc agctagagtt tatgcatgat atgaccatgt atactttatc
93601 ttatggctca ggacagctaa aacttattga ttagcagaa ggttatgaag cacaaaaagc
93661 tacaatagtt aactcatttc ccgaaattat taaaacatta gaaaaggatg attcagaaga
93721 tggaaaaaat gaatagttta gtagatttaa atacagcaat tagacaaaag aaagatgtta
93781 ttgtcatgat tacacaagat aattgtggta gtgtgagatt tttaaaaagt gtaatcccta
```

Figure 17 (contd.)

```
93841 tgtttcaaga gtcaggtgac attaaaaaac ctatcttaac attaaatcta gatgctgaag
93901 atgtagatag agaaaaagct gttaagttat tcgatatcat gagtacacca gtattaattg
93961 ggtataaaga tggtcagtta gttaaaaagt atgaagacca agttacacct atgcaattac
94021 aagaattaga gtcactttaa tttggaattt cctactatct gtgctatact ataatagtac
94081 aaggtagtag gatttttttaa tggaaggaag atgacatatc gcaaagaata aaacattaac
94141 gatatataat agtgatagat attttaatat acacacaaaa gataaagata aaattaatga
94201 ggctattaaa gtaacacacg gtaatgaaga agaaattgaa aagaatatgg atgaattaat
94261 atctaagtct agaagatata tcatgaggga tgaaaagcat tacatgctat ttaatgagaa
94321 gtacaataat gataggctta tagaaaaagt atgtaaacac ggtggtaaag ttacatacta
94381 tactgattca gtattaccttt actatgtttt aaaagactta tctagtcacc ctgactcaga
94441 agttgtttat cgtatgcgca acggttttac tgcaaaagaa gtagataata tagctttatc
94501 attcatgggt acaaaagtta ttattgatat ttctgtagta tttccttatg taaaccctta
94561 tgatattatt agaagtttac atgatattaa aacaaatgta gatgaagttc atttatcatt
94621 tccacgaata ttaggggtag atgaaaaaca agaaaagttt tatttctttg atggtgaagc
94681 ttatgattta aaacccgaat ataaagtcga ttttgcagat aaaattgagg tatctttatc
94741 agtatggaaa atgtatatct atatcttaac aagtagtcgt gattttgagg atgtagacaa
94801 tgtaattacg aaattaaaac aacaacgaaa gattaagata taaggtgatt atatgagtac
94861 agcaaataga agagatatag caagaaagat atcagagaat acaggttact atatccaaga
94921 tgtagaggaa atactaagtg cagagacaga tgctatttct gactgctag aagaagggta
94981 tactaaagta aagaatcata aatttatgca aatagaagtt attgaaagaa aaggtaaaaa
95041 agcgtgggat ggtctgaata aagaatactt ccatttacct aatagaaaag ctataaaatt
95101 caaaccacta aaagaactag aagaggttat tgatagactt aatgaagaag agaaataatt
95161 ctcttcttttt ttattgaca aggtttaaaa tatatggtat agtattatta agtaaaaaa
95221 ggagaggaat taaatgaaag tattaatctt atttgaccac attagagaag agcattttc
95281 tgtaagtaaa gatgggagtg tgaaatctaa tgtactaaat acacctaacg gaaaaacact
95341 taagaaatta cttgagaagt gttctaactt aaagagagat aaaacaaaca gagattatga
95401 tattgatttt ctctacaatg cagtacctac acctattaga aatgactacg gtaaaatcat
95461 taaataccaa gatgttaaac aagcagaagt aaagccatac tatgagagaa tgaataaatat
95521 tattattgat aattcttatg atatggtaat tcctgtaggt aaactaggtg ttaaatacct
95581 attaaatgtt acagctattg gtaaagtaag aggtgtacca agtaaagtaa ctattgaaaa
95641 tggaacatct tctcatgatg tgtgggtatt acctacttat agcattgaat atactaatgt
95701 aaataaaaat agtgaacgtc atgtagtatc agattacaa acagttggta agtttgtaga
95761 gcaaggagaa gaggcatttta aacctaagga agtatcttca gagttggtag ataacattga
95821 aagagtaaga gaaatattca ataaggaagt aagaatgat aattatgatg gggtagatat
95881 taccgcatgg gacttagaga ctaactcatt aaaacctgat aaagaaggaa gtaaacctttt
95941 agtactatct ctatcatgga gaatggtca aggtgtaact ataccettat acaaatcaga
96001 ctttaactgg gaaaacggtc aagatgtatat tgatgaagtc ttagaattgc ttaagaattg
96061 gttagctagt aaagaagata ttaaagtagc acataacggt aaatgattg ctgttgtaaa
96121 atccctctca tatcgggcat agctttaagt agctgataag agaacctaag tcctgtaata
96181 aggatagtgg taatcccgag cttacattat tggtgacaat agatggggtg tagagactga
96241 gccgaggttt tgtagaccaa ggtgagacat agtgtatcga cttaatagag gtggtacagt
96301 gaaaaaagat tatatgcat cagttaaaaa taacaaaaaa gtatgtagaa gatgcaacga
96361 agaattagat ttatctaact ttaaaacata taagaagaat gataaaactt attatcaaag
96421 tatgtgtata ccttgtcgga aggaatataa taagttagat aaaaactaaaa atactattaa
96481 aaaatgttat gagaaaaacg gagataaata tagaagacaa agtaatgagt ataatacttc
96541 tgacagaggt agagagctta ataaaaatag gtctaggaaa tacagagaaa acaattcttt
96601 aaaatcgaaa gctagaagct ctgtaagaac cgcattaaga aatggttctc tcataagacc
96661 tgataagtgt tcagagtgta ataaagattg catacctgaa gctcaccatc ctgattatac
96721 taaaccttta gaaataaaat ggttatgtaa atcctgtcat gaagatactc atcataaaaa
96781 ataatcacac tatgtaaatg agggacatca agcccatttta ggtaactaca aacaaaccta
96841 atggtaaggg cttatgaagg tatagtccgt tctatatagg aatatatagg ctaaaacgaa
96901 atatgatatt aagttcttaa tgagtactga aaactttaaa gattttgaga gtattcagga
96961 tactaaagta ggttggtacc tagctgttac ccaagaagtt aaagaatctt taagattatc
97021 tgatttagct tatgaggtta cagatgtcgg aggctatgat aaaccattag aagactttaa
97081 attatggttt gttactaagt tattaagatt cttctcagat aaaattaaag agatacagaa
97141 agaaaataaa aagattgcta agaaagagta tgatgttaaa gctcctgaat ataaagaatg
```

```
97201 gttagagaat aaattaaatg aaacagtagt agaactagat gatactgaga aaaaatttag
97261 agttagtgaa ttagagaaaa agtatattca actaggtctt tcacctgaaa ttgtaaatat
97321 gaatttagtt atggataatg atgaattcat aaatattgca gaacaatcac ctgagtacat
97381 ggggttatct gactacgcta agtcttacac gttaaatact gcaattaatt taattaatga
97441 gtatagagat gtaaaagatg tagttaatga tattgacgga ggtaacttta attatgattg
97501 gttccctatt gagttaatgc atccatacgc atcaggagat actgatgtat gtagaagaat
97561 tcattgtgat gtaattaaga aacttaaaga acaagataga cctaagtcaa tgcatttatt
97621 agaagttaat tacccaagac ttactaagtc tttagctaga attgaatcaa atggtttata
97681 ttgtgactta gattatatga aagaaaatga tgagtcatac gagtctgaga tggctaagaa
97741 ccatgctaca atgagagagc actgggctgt taaagaattt gaagaatacc aatacaatct
97801 ttaccaaatg gcgttagaag aacatgagaa aaagccaaaa gatagagata aagatatcca
97861 tcagtacaga gataaattta aagatggtaa atggatgttt tccccaagtt ccggagacca
97921 taaaggtaga gtaatttatg atattctagg aattcaatta ccttatgata aagaatatgt
97981 caaggaaaaa ccatttaatg ctaatgttaa agaagcagac cttacttggc aggactataa
98041 aacagacaag aaagctattg gttatgcgtt agataattta gaattaaaag atgatgttaa
98101 agagcttctt gaattactta aatatcatgc tagtatgcag acaaaacgta attcatttac
98161 taagaaaatta cttaatatga ttaataaaca aaaacgaaca ttacatggtt cttttctga
98221 gacaggcaca gagacatcaa gactaagtag tagtaaccct taaattgggg ttgtaaaact
98281 ttgttaactg cgggaagaga ctcgttaggt cttaactact aacttataat ggaaacatat
98341 ataagggcaa acagtaacgt gtttgatata gtaaaaaggt taagaataga gagaatccgc
98401 atccaagacc ctgaaagtat ataaaagtat gggtaaggtt caacgactag gtgttgagac
98461 aatacaatca atacacaccc acgaaagcaa aggtattatt tctgtggtag ggaataataa
98521 ggagagttat atgaaagaga tttggaagaa agtagtagga tttgaaaact acgaggtaag
98581 taataaagga aaagtaagga atataaaaac taactatatt ttaaagccgt ggataataaa
98641 ttccggatat gagcaagtat ctataggtat tgctaatgta ttagtacata gattagtggc
98701 tatgacattt atacctaccg acagctatag tatagttaac catattgata ataataaatt
98761 aaataactgt gttgaaaatt tagaatgggt aagttacaaa ggtaatagtg ctcacgctaa
98821 taagcaagga agattgaata cttatagtgc aagagaaaaa cttagttctg tatctaagaa
98881 agccattat caaaaagata tggaaggtaa catcattaag ttatgggatt caccaagtga
98941 agctgaaaaa gaatctaatg ggtactttaa aagtactaag attagttccg ttgctcacgg
99001 taaacgtaag catcatagaa gttatacttg ggaatacgta tataaggatt caaagagaag
99061 tttaaataag tctattaata tgtatgattt aaataataat ttattatatg aagatttgac
99121 aatgaataaa attatgggta tactagaaat gaataatcat aaaacattaa gagataaact
99181 aagaaataca gatgactttg ttgaatacag aggatataaa tttaaaaata ataattaaaa
99241 cctaccacag aaatgatata tgatatagtc tactcaaatg tgagagctat tgtgttacct
99301 aaacagtaac agattgtaaa ctaaaaagct tacaaattat agaatttaca aaacttacct
99361 gcacacacat cagatgtaaa taagtttgat tacaaacatc caattaaacg ttcatttgtt
99421 tctagatttg aaaatggagt actgctaggg tccgactata gcgccctaga gatgcgtatt
99481 atcggattat ttactaaaga ccctgatatg ctacaatcat tcttaaatgg ggaagatatc
99541 cataaggcta ctgcaagtat tgtttacaat aaaccagtag aagaagtaac taaagaagaa
99601 cgacaagcaa ctaaagcagt taacttcgga ttagcctttg gtgaatcacc cttctcattt
99661 gcagtaaaa ataatatgga agtaagtgaa gcagaagaaa tatttgaaaa gtatttccaa
99721 acaaaaccaa gtgtaaaaac ttctattgac aatgtacatg agtttgtgca acaatatggt
99781 tatgttgata caatgcacgg acatagaaga tttatccgtt cagcccaatc aacagataaa
99841 aagataaaaa atgaaggtct aagacagtca tttaacacta tcatccaagg ttcaggtagt
99901 ttcttaacaa acatgtcttt aacttactta gatgattta ttcaatctcg taatttaaaa
99961 tcaaaagtta ttgccacagt acatgatagt atcttaattg attgtcctcc tgaagaagct
100021 aaaattatgg ctaaagtgac aattcatatt atggaaaact taccatttga tttcttaaaa
100081 gcagaaattg atggaaaaga agtacaaatt cctattgaag ccgatatgga aattgggtta
100141 aactataatg atatggttga atatgatgag gaagaaatag atacatttaa ttcttaccaa
100201 ggttatatta agtatatgat gaatttacag accttagaag attataaaga gtcaggtaaa
100261 ctaacagatg aacaatttga aaaggctact aatgttgtta aaagtgaaaa acatatttat
100321 caagaaattt aataaaagta ttgacaatat agttaactta tgttatacta tataagtaat
100381 aaatataagg aggaaaaaga gtgaatacag gggagattag atttaatcgt tctatggatg
100441 aatggattat aacaagcatg taccaggatg agctaggtgg gatgaatatt gttgttacat
100501 tctataatag agaagaaaat aaacatggtt ctacagtttt accaacagag tcatctactg
```

```
100561 gagaagtaac agaggaattg gcaagtcttg aagaagaata tcctttagct ttaccttaa
100621 gtagtatctc agttaatatt taaaaggagg aactgataaa tggaaataca cattgattcc
100681 ctagatttta caaactttac tattaaagat agaaatggga actcacaaga gtttgatatt
100741 acagatgagt taagaattac agagtataca atacaagagg attttatgca acaatcagct
100801 aaatatgctt tttgggcttc tatattagag aaggtaagag catattctga aatggaacaa
100861 agaaacctag aaacaattgg tagtaagcta aaccttacaa ttagacaaga gtacgaacaa
100921 caaggtaaaa agcctactaa agatatgatt gaatctagtg tttatattca cgattcttat
100981 caacaacaac ttaaagttgt tgaggcttgg aattataaag ttaaacaact tcaatatgtt
101041 gtaaaagctt ttgagacaag aagagatatg atgattcaat taggtgcaga attacgacaa
101101 acaaataaaa atggtggaat tactaatcca ttttcacatt aaaaaataaa gtaaagaata
101161 taattgacaa atataaaaaa ctatgttata ataataagt aaattaatta aaaggagaaa
101221 agataattat ggatttcaat caatttatta acaatgaggc aagcaaatta gaaagcaata
101281 acagttcttt taacaataat gtagagagct acaaacctaa aaaccctgta ctacgtttag
101341 gtaatattaa agatgcaaac ggaaataagg ttgttaaaga aaatgctttt gtacgagtat
101401 tacctcctgc acaaggaaca aatgttttct ttaaagaatt tagaacaaca ggtattaact
101461 attctaagaa agatggttct caggggattca caggggttaac attacctgca gaagagggtt
101521 catctgtcct tgacccatac atcaggatt ggataacaaa tggtgttcag ttcagtagat
101581 tccctaataa accaggagta cgctattaca ttcatgttat tgaatactt aataacaatg
101641 gtcaaattca accaaaaacg gatgctcaag gaaatgtaat gattcaacct atggaattat
101701 ctaatacagg atataagaa ttattagcta acttaaaaga cactatgtta aaaccatcac
101761 ctaatgcacc tcatagcttt atctcagcaa ctgaagcatt cctagttaat attgttaaag
101821 ctaagaaagg tgaaatgtca tggaaagtaa gtgtttatcc taatgcccct ttaggtgcgt
101881 tacctcaagg ttgggaacaa caattatctg acttagacca attagcaaaa ccaacagaag
101941 aacaaaatcc taatttgtt aacttcttaa tcaataacgt taataacaca gagttaagtc
102001 atgataactt taaatttaac cgtgaaacaa atgtcttagg tgaagaacct tcagagccta
102061 aacaagcacc cacacaacaa gatgtagata gtcaaatgcc aagtaatatg ggaggacaac
102121 ctaatcagcc tcagcaaggt caagtaggtc agtatgcaca acaaggtcaa agtaatggtc
102181 aaggacagca gttacaaggt acacaacaac ctatcaataa cactcaattt ggtcaaggaa
102241 ctccttcagg acaacaacca agtaacacag gttctgttga tgggataac ttagcgcaac
102301 aacaatcaca acctgattca aacccattca atgattttga tgttagcagt gttgatgatt
102361 cacaggtacc ttttgagaca caacctcaaa atacacaaca agcacctgaa ccacaacaaa
102421 ctacacaaga gcctccaaaa caaaacaaa cgcaaagtat tgacgatgta ttaggtgtc
102481 tagacttaga taacctataa gatatagagt gccttagagc actctttat ttgagatata
102541 attactagga ggatattaaa tggcaagagc aaaaaaaggt aaagaagtcg atttaacaga
102601 tttaaaataca attgatttag gtaaagaatt aggattaaca ttgctatcag atacaaacag
102661 agcagatatt aaaaacgtta tacctacaat ggttcctcag tatgactata tttaggtgg
102721 aggtattcca ttaggtcggt taacagaagt ttacggttta actggcagtg gtaaatctac
102781 ttttgcagtt cacttatctc gaattgcaac acaattaggt gttatcacta tttggattga
102841 tattgaagga acagcagata acaatcgtat ggagcaactt ggtgtagatg tttcaaaact
102901 attctctatt caatcaggag aaggtagact taaaaataca gtagaattat ctgtagagca
102961 agtaggtaaa gaattagagt actggattga cactttcaat gaaaagattc cgggagtacc
103021 tattgtattt attggggact cattagggggc tacaagaact cagaaagaga ttgatggcgg
103081 tattgatgag aagcaaatgg gtcttaaggc atcagctacc caaaaagtaa ttaatgcagt
103141 aacacctaaa ctaaatgata caaacacagg gttaattgtt attaaccaag cccgtgatga
103201 tatgaatgca ggtatgtatg gtgaccctat taaatctaca ggtggtagag cttttgaaca
103261 tagtgctagt ttacgtatta aggttcataa agcatctcag ttaaaacaga aaagtgagtt
103321 aactggtaaa gatgaatacc atgtcacat tatgcgtatt gaactaaga aatctaaact
103381 atcacgacca gggcaaaaag ctgaagcaga cttactatct gattatatgt taggtaaaga
103441 agatgaccct atcttattaa atggtatcga cttagaacat actgtatata aagaagcagt
103501 tgaagaggt ttaattacca aaggagcatg gagaaaactat gttacattga atggtgaaga
103561 aattaaaactt agagatgctg aatgggttcc tgtacttaaa gataataaag agttatatct
103621 agaattgttt agtagagttt atggagaaca cttccctaat ggttactcac cattacttaa
103681 taacaaagta atcgtaactc aattagaaga gtatcaagct cttgaaaact actataaaga
103741 atgggctaca gataataaac aagaggaaca agaggaagaa ctaaaggag aatctcaaga
103801 aaaggattct gaataataga tggataattt aatagataaa aacatgaatc aggtaaaaga
103861 atctttgggg aatgcaaatt cctcagatgt tcttccttta ccttataaag atatagcaaa
```

Figure 17 (contd.)

```
103921 gaaatttgaa gaagtaaaag aaaaaggtga atcaattatc attgaagaag gtggattccc
103981 ttatacagat tctacagtga tgtatataga acatgtaaca gatagatggg caggaggata
104041 ttccttaatt agacatgaag gtgaagaagt taaagtacct aagactatcc atttctctga
104101 tatatatgtt aaagataaat cacacaaagt aagaataatc ttcgaggggg ctaatcctta
104161 tgaagaaagc taataatggt aatagatatg taatagatat agatggtata cctgttgatt
104221 ttgaaaggga tttagatagt ttacttaata ggtataaaaa ccttagatgg tcgttatatc
104281 ataggtacgc agggattta tctaatgatt ttgaaagaca agaactaaga gaatatattg
104341 atgagcaatt tattaaatta gttaaagaat ataatattag aagtaaagtg gattttcctg
104401 gatatattaa agctaaacta actttaagag ttcaaaatag ttatgttaag aagaatgaaa
104461 aatataaacg tactgaaatt atcggtaaaa aagattatac agtagagtct taacagaag
104521 atttaaatga agacttcgag gataatcaaa ttatgagtta tgtatttgat gatatagaat
104581 ttacagaggt tcaaagtgag ttacttaaag aattacttat taaccctgaa agagaagatg
104641 atgcctttat cgtttctcaa gtagcggaaa agtttgatat gaaaagaaaa gaagtagcaa
104701 gtgagttgac agaactcaga gactatgtta gatttaaaat aaatgcatac catgagtact
104761 atgctaagaa agaattaaat aaccatagag ttaatactga aaatcatatt tgggaaaact
104821 agttacagtg ccttccttgt gttatattat tatcgagaat tcaataataa agcatagaga
104881 aggcttttt ctatgtctta tagaatgctt taaaatagat tactaaaata aagattggag
104941 attaagctta tggctaaaaa gaatgttaat gatgtattac aacaagaatc tgttacagta
105001 gcagataagt atttacaagt taaagttaac cgtgacggtt atactcgtac acatgaagga
105061 caatatgcgt acaaagtagt ttcagaggga gaagaattat tcttatacc tgtacaaaca
105121 gatggtaaag gtacattaaa tgtaatgaag aaatcaccta ttgcttacac tgatggagac
105181 aatatccatt tcgtagtaaa cacagtagta gacccttata atcactcatt tatccgtact
105241 gaagatatta aaggattaga taaaggtaaa caacttattc aagcttcttt agcttcgtt
105301 gaagaccgtt tcaaatttgg tgtttataac gtatttgttg caaacaacaa agaggatgta
105361 ttatctattg tagaccctac agataatgat gcagatgaag ttaagatag tttagagcac
105421 gcacatgaag atgtaattgc ggattccct gctagccctg ctcgtaagga cgttaaaggc
105481 gtagattcag gagaaggtca aggagacact tcagaaccat cagcacctaa gaacgttcaa
105541 gttactccta aggaagacgg agcagacgta tcagcagaat aatatataga taaggatggt
105601 aaatttggct aagttaaatt tatacaaagg taatgagtta ctaacagcg tagaaaaaac
105661 agaaggaaaa tcaacaatca cgattgagaa tttagatgct aatacggatt acctaaagg
105721 tacttttaaa gtatcattct caaatgattc aggagagtca gagaaggtcg atgttcctca
105781 gtttaagaca aaagcaatta aagttattc agttacccctt gacgttgata gtttagacct
105841 tacagttgga gatactcacc aactatcaac aactatcacg cctagtgaag catctaacaa
105901 aaatgtgtca tttgaatcag acaaatcagg tgttgctagc gtaacatcag aaggcttaat
105961 tgaagcagtt agtgcaggaa cagctaatgt tactgtaact actgaagatg gtagtcacac
106021 tgatattgtt gctgtaacag ttaaggaacc tatcctgaa gcacctgcag acgtaacagt
106081 tgaacctggt gaaaatagcg cagatattac tgtataggag gacaataaag aatggaaaag
106141 acattaaaag ttatagtaa tggtgaagtt gtgggctctc aagtagctaa taacgatgga
106201 gctactacag tatctattac aggcttagaa gccggaaaaa cttatgctaa aggagatttt
106261 aaagtagcat ttgctaatga ttcaggtgaa tcagaaaaag tagatgttcc tgaatttaca
106321 actaaaactc ctactgaaga accttcagga gacgcataat aattaagacc aactaaaaag
106381 ttggtctttt tttattgaca atttataata tctatgatac actatataag aattaagaaa
106441 aggagggaa agtaatggat attccaacaa tattatttag aaatccatat gattatacga
106501 aagtaaaaaa attaatggaa aacaaagagc agtatattgt agtaaagttt gattctgttt
106561 ctgttcataa tttaaatgtt caaggtatga tgaatgtcat ccaagattac ctacacatct
106621 atggttacag agttaaagag tacggacaag aaaattcttc taaagatgat gaaagagacg
106681 ttaaaggcta cttatatgaa agagtaggtg agtagggtat gggaattata gtaaactcca
106741 accatattca atcagacact ttatatgagt atgatagctt ttttgatatt gagaaagtag
106801 atacatttga agaaggattg ctttcaatac aggatgagcc aactgtttta gcaggattca
106861 tctatgatga tatcacattt aataaggtca ttaattctaa ttcagatatt gatgattata
106921 ttaagaataa tgatatttat tatgtctctg atataggatt acttcctgat acttttatca
106981 ctgttgattc tgatagaaaa tattattcat tattacaaca gataactgag ttaagtaaag
107041 accctttcc taaatgggta gaggatgatg caaaaggttt aactaagtat taaactttc
107101 aagattttga agatgtattt gatttaaata gttttttacaa aaaagaagtt gacatggtaa
107161 gagaaaagtg ctataataat ggtaatgtat atttattata tgaggttctg cctgattata
107221 aattacctct agcttatagt ttactttcaa acaaggagca tggtattgtt attatcggtt
```

Figure 17 (contd.)

```
107281 cacagacacg ttctaataat gatatactga cttttatgt taaaggtatg gatgctaagg
107341 caatagctag tatgttcaat gtagaacatg attatgattc taatattttc catacatttg
107401 taaacagtca cattaatatt ttaggaaatc aaataactaa gtttataaga gagaaaggaa
107461 gcagttatga gtaactataa aacaatagaa gaagtacaag cagttattat tggggtatta
107521 tttaaagatg aaggtaaaat tgtaacatct aagtttaata aaattactaa agagtttggt
107581 ttagatagaa tcggtaaaga tgaccttaaa gaaattgtag aggatattag acaagacgct
107641 tatctaaatg aacttaaaaa caaagcaatt aaaggtaaag taacgttagg tgatttaaaa
107701 gatgttgcag ataaccaagt attcgaaggt aataactacc atgaagaagt atctacttat
107761 gtagtagcta aagaaaaaga attgtctcac ttaagagaac agcgtaagca caataggcat
107821 actgcatacc ctcaaattat gtttgatgaa cttaaagaac atatgcttaa ggaattacaa
107881 ggggaaacat tagtagaaca tcacggaagt aaagctaata ttaatgatac agagctaatt
107941 gtgttactat cagatttcca tattggaagt attgtatctg atatgactaa tggtaaatat
108001 gattttgaag ttcttaaatc aagattaaat cattttatta atacaacagt taaagaaatt
108061 gaagataggg aaatttctaa tgtaactgtt tactttgttg gggacttagt agaacatatt
108121 aatatgagag atgttaacca agcatttgaa acagagttta ctttagcaga acaaatctct
108181 aaaggtactc gattacttat tgatatccta aatgtactat ctaatgtagt ttcaggagaa
108241 ctaagatttg gtattattgg tggtaaccat gaccgtatgc aaggtaacaa gaatcagaag
108301 attttataatg ataacattgc ttatgtagtg ttagattctt tattgttatt ccaagaacaa
108361 gggctattaa atggtgtaga tattattgat aatcgtgaag atatttatac tattagagat
108421 acctttggcg gtaaatctat tatcattaac cacggagatg ggttaaaagg taaaggtaat
108481 catatcaata aatttatctt agatagtcat attgacttat taattacagg tcatgtacat
108541 catttctcag taaaacaaga agatttttaat agaatgcaca tcgtagcttc atctccgatg
108601 ggatataata actatgctaa agagttacat ttatcaaaaa ctaaaccttc acagcagtta
108661 ttatttgtaa ataaggaaaa taaagatatt gatatttaaaa cagtattttt agattaagga
108721 tggttaataa atggatacaa ttttattat aggtgtagcg tttataactt ttgcaacatt
108781 taacatagtc tttagattat ttgatttatg gactacagag aaaaaaatgg taagtcaagg
108841 acaacctcca ctaagtaact ttgagtacta tcatgtgata gtaccttact tagtaggtgt
108901 tattgttatt atactgagta ttattttttag ggattccttg tattccgcac aatcagggtt
108961 cggtgttatt attacaagct ttattttacat gctagtttat gttataattg gtcttgtagg
109021 gtcatttgta cttacaatat tccaagctag aaaagctaga cagtatcaaa cacaggagga
109081 taataatgaa gttcaatgat atttatgagc aattaattaa aaatgataca gtacaaaaca
109141 ttcatgagtc tcaagatgac aaaggaaata tttatacaat acagtttttgat aaaggtaatg
109201 ataagtattt atttaatgtt attaatgatg gattcttgaa agaaatgaca aatggtatgg
109261 tagaccatcc tgaaggtcag ccatattcag taagtttaat caataaagaa acacctagta
109321 tgtcagtgaa acaatatttta acagatgtag aagtatattgt acctactatt agaaaaaatgg
109381 aaaaggattt cttatagagt caagtctttta cttgactctt tttactatat atggtatatt
109441 aatatagagg tgacttaaaa atggattttta attttagtgc ttttgataat agctcattag
109501 caatgagaat tagtgagggt gtatactatt tcaatgatac gccttattac ttattgagc
109561 atgtagaaga agaaatgtct gagtatgtta ttgtatatga catacatgac agagaggaaa
109621 aagaaaatcc tcagaagaaa tatagaatag aaccttacca acgtacaata ccgggaggaa
109681 cacctcttag taatttaatt aagagtatga tgcctcaacg taagtatcct aagaaggtta
109741 cagaagaccc tatatttgta gctaatgtta ttcctttagg aacagataca gtaacaggta
109801 aaaccggtaa aggatttttt gaaagagata aggatagaac tatctattct caaaaggaac
109861 caactaaagt cgttcatggt caatacacag gtgttttat aggtctaaca agtgttaagt
109921 ggaatagaac atataccccc ttagaaagtg ttgttgagta ctacaaaagg gttaaaggag
109981 ataggtaaa tgtctaatga tgtagttaag ttctatgaaa aagatattaa agaccttatc
110041 agaactaaaa aacacatgtt caaagacgat gaaataacta gtgatataaa cgatatacga
110101 atcttcaatg agaaagtcat ttgtcaaggt aaatgtagaa cagattgttt agtgttagac
110161 cgtaatggta cagtaatggg tatagagata aaaacagaac gagactctac acaaagatta
110221 aataaccaat taaaatatta tagtctagta tgtaagtatg tatatgtaat gtgccatgac
110281 aaacatgtac ctaaagtaga acaaatactt aaaaggtaca aacataatca tgtaggtata
110341 atgagttaca ttagttttaa aggcaaacct gttgtaggta aatacaaaga tgctacacca
110401 tcaccacata gaagcccttta tcatacaatg aatatatttat ggaagacaaa cttaatgaca
110461 atacttagat tgattagaga ccctcatacg tatagaacag ggatatagcta taatgctagt
110521 ggtagatata gtggagggga aggtaatttc tcccaaacaa ctcaaagtaa aagaatgaaa
110581 aaacctgcta ttattaacca aataattcat tatgtagggg tagataatac ttataaactc
```

Figure 17 (contd.)

```
110641 tttacaagag gtgttatcta tggttataat aataggtggg aagttataga agaagatttc
110701 tttaatacta tgaagaatgg ggtaagagta attaatgagc aaagacaaac caaatagacg
110761 taaagagata cagcatcaac ctgttaactt tgcccctacg aatactttaa caggagctaa
110821 taatagtttc tttgctaaaa agccttcaga gcctaaagat gcaacatctg ttattgaata
110881 tcgtatacta tttattaaaa gatttgataa cgtaacaagt acagatgtga aattacagaa
110941 aaagtatgca ctaaatctta ttagtgaagc acttgatgtt aaagaaactt acttgtctct
111001 taagcaaaaa ggaaaaaaaa cagaatctat tttgcataca gatagagttt attatgttca
111061 tagaggtaaa aaacttattg gaaagtgtag tatcagagaa caaagaacat ttaagggtaa
111121 acatttgata tttatattca aaacaagaca tagagttaaa gcagaaagga aagataaata
111181 atgttaaaag gattttcaga acatgtagac aaacctacaa ctattaagac cttatacaag
111241 accttaacaa gtggtaaagt agaattacta ggtgtatctt acgatagtga ttacttccct
111301 tcaggtgtta cagtacaatc ttacattgag gatataggta atgaagatga gggtctacag
111361 tttgttaata aggtaaatgt agtagaatca atgaaacagg ctgtagtagg tatgaataat
111421 caattaggtt cttcaggtct tggctatgtg agaactgaac aacttaaaaa agagttggaa
111481 gagactggac taatgacaga tttacttgct agaggtacta acttaacctc tactaagaaa
111541 gtagatattg taagtacttt tattgagcct gaggtaacat accaaaatat tactatagct
111601 aaagatatta aactacgttt gtataaagta gaagaagaat caccattaaa tggttacact
111661 catattgtat acttactta tacagaaaaa ctatatgatg gtcaaacact cttcggtatg
111721 ctctctaaaa aagataagtt atctaaagga gatactgata aattattagc attcttcaga
111781 aacaatagtt taataagtaa aagtgtattt tgtgttaagt tattaagtaa agactactac
111841 tttaatttat ataatacaca tgagacaggg atattctttt tagaagacac agatgttatt
111901 actattgctt gtggtcagtc atatgttaaa gttaacacta aagatattaa gtctagttat
111961 gttaaaattg aagataagac tcataaatta actgagctag taattaacct aaagggtgac
112021 gacacattaa ctattttatt ctaggaaaat gttataaata tgtgataatt aagtataaat
112081 atacgttata taagaagttt tcataatgtt tttaatacag aaactagtta agttttttct
112141 acttgctcta gtttctgtga aattatattt atgaaaagtt aaaatatctt ttaggtaaag
112201 gctttgtaaa tagttaaaaa atatattaaa attttataca aagtagttaa taaaattata
112261 ttacatttat atattatgaa ataataacag aaattgtgat atattatata gtgtaacctt
112321 gaaacagttg atgttgtagg gtttgtttat gttcgttaaa ctggtttcag aacatcagtt
112381 accataaata aatgacagtt aaggagagct atataatggc tagaaaaaag aatttaagaa
112441 ataaaaacag tgatataaaa gttgttcctg ataaagaaaa agaaagtata ttatctaagt
112501 tataccataa taagttacta cgttcaaagg tagataatgc attagatgaa gatatgagtt
112561 atgatgatat tatagaatta tgtaaagaat atgatttaga attgtctaaa tcagctatta
112621 caagatataa aagtaaaaga aagaagcta ttgaaaatgg ttgggatta ggagaattaa
112681 ttgataaacg taaaaaaaca agtgtaaaag atattaagga aaaagaaact cctatattag
112741 aagaggagca actttctcca ttcgaacaat caaaacatca cacacaaaca atttatgatg
112801 atattcaagt actagatatg attatttcta aaggtgcaaa aggattagag tttgtggaaa
112861 ctttagaccc tgctttaatg atacgtgcaa tggaaactaa agataagatt accggaaatc
112921 aattaaaagg tatgtcattt attggactta gagaattaca attaaaacaa acagctcaag
112981 atacagctat gagtgaagta ttattagaat ttatacctga agagaaacat gaagaggtat
113041 tacaacgatt agaagaacta caaaatgaat tctacaaaaa tctagattta gatgaggaaa
113101 gtagaaaatt aaaagaagct cttgatagag taggctatac aatttagata gtgaggttag
113161 agtaatggca gatgagatta gtttaaatcc aatacaagat gctaagccaa ttgacgatat
113221 agtagatatc atgacatact taaaaaacgg gaaagtactg agagttaaac aagacaacca
113281 aggagatatc cttgttagaa tgagtccagg gaaacacaaa tttactgaag tatctagaga
113341 cttagataaa gaatcattct actataaaag gcattgggtt ctctataatg tatctgttaa
113401 ctctcttata acatttgatg tttatctaga tgaagaatat tcagaaacaa ctaaggttaa
113461 gtatccctaaa gatactattg tagaatatac aagagaagac caagaaaaag atgttgctat
113521 gattaaagaa atacttacag ataataatgg taattatttc tatgcactta taggggaaac
113581 aatgctctttt gatgaaaata aattaaataa agttaaagat taggggttgac agctcctata
113641 gtttatgata tagtatatgt atactaaaag taaaggagct aacaattatg tttatttcat
113701 taaatcaaga agagaaagaa ttattaacta aagaggaaag taaatacaca ccattagaaa
113761 catcaagaga gtttaacaca cctaaagaag aattcattgt aacaagctat aatgaaggta
113821 aaccttttaga ttacattgca aaagaagcta aggtaagtat gggattaatt tacacagttc
113881 taaactacta taaagtaggt aagcgtaata agaaatcacc tgtagaagaa agaattgcac
113941 atatcttaaa agataaaaac ttagtcaaag agattattaa ggattaccaa tatatgaatt
```

Figure 17 (contd.)

```
114001 tacaggacat ttatagtaaa tataatcttc ataagaatgg tttatattac atcttagatt
114061 tataccatgt ggagagaaaa tctgaactta aggacaaagc attagaagag gataatattg
114121 tcgttgagta agtaaagagg ttataatatg agaaataaaa aatcatttca agagcagtta
114181 aatgacatgc gtaataaaga gaaatgggta tctgaagagg agttcactga agaagtggct
114241 cctcctgaag aacctgaagt agaagaagaa aaactatata ctttaaatga gttaaaagag
114301 agcttactag atgctcaagg attaaaagat gttgtagctg attttcctgc atctaaagat
114361 ttatatgaac ctaataagtt atatatctgt acaataccta aaggatatca gtctaccgaa
114421 gtacaaccag gacaatatat tggtattagt actggattat tatcagagtc agaagacttc
114481 agccatttaa gaggtcaaat gcctagaaac ttatatgaaa cttctcatgt tttaaaacct
114541 ttgatacgta ttaataatac aaatattgaa taccaacaac atgagttact tgaagacatt
114601 aaggatgaca aaaagatata tgatgtagag ttagaagact taagattagc aacaggagaa
114661 gaagtttctc atttagaaat tgttgataat aagtttttg aaagtcgtat taatgaagtt
114721 cttgaccgat acactgaact aacggattcc aatgatttac ttaagtacta tagtaaatta
114781 cgagaattag taggtagtga caaaatgatt tattgttcac tcctcgataa atgtgttaaa
114841 attatagatt aatagtagtc tcctcttata ttataattgt aagagggac attttgtat
114901 agaggtgtta attatgtcaa gaaaagcaag tatattctat atactagtgg ttattgtttt
114961 ggctttctct atctcatctt attatatatc ttctttcatg tatcacgaca aagcaaaaaa
115021 tgaagtctct actgagttat cgaacacagg aaagattaaa gaagaaaaga acgtagaatt
115081 tgtcggtgac tacacattga aaaaagtgga agataataaa gcttatttta tggaaacatt
115141 acctacttac ctaccaggta gaacaggaga taacagcata gatatgaggt actacaaaac
115201 aagtagattt aaggaagggg taaatttcaa gcttattagg gtatatactg aagatggaga
115261 agataatcca attcataagt ataggtttga agcagtacca accaaaaagt aataaggagg
115321 tgacttaaat gacaacatta attgtcgtca tctttattgc tatcatttat tacttatgga
115381 acagtgattg agtcaagtta attcttgact ctcttttgt tttatggtat attaatatat
115441 agaaaggaga gattaactat ggaaatggca gatttagaaa gatttgatgc atttgtaaga
115501 ctaatttcag atgatgagct ttcggaggaa agaatactgg agttaagcgt agacttacta
115561 aacccgatac tagaaggagg tacagcttac aaggctaaaa aacgtattaa gagtaaattt
115621 ggtaagttag aagcaaaaaa ttttaaacga aactataaat tcttacttaa gtcgatagct
115681 caaatagacc aaaggagata ggacaatgac agaaagggaa aaattaatta aagatattga
115741 agaggctaat agagacatac agttacagtt aaaagaagta gataattata aggacagcat
115801 acgttctaaa ggaacaagaa attatatttc tacaaaggta ttagattcta ttatggttgg
115861 tttcatagtt agttttttaa tactcattat aatgcgtgta cttgaatatt ttgtaacagg
115921 taatgctgtt tactcaccct tagcgcctgc agttattatt atgtttgttt tagcactagg
115981 tacatggaaa gtaagtaaga tgaacaaaat agtatccttat agaggaacta ttaagatgta
116041 ctgggaacta agtaatgctg agcaaaaaca agctaaggta tttaagtatc ctaatgatga
116101 agtagatatt gaccagttat atagtgctga taagtatctc gttgatgcac tttagtgggg
116161 tatcattaaa aattaaataa atttataaat acctgttgac agcctgttga cagcaggtat
116221 tttttatagt atactttaga tataaagaaa aaggaggtaa tataatgata cccgtaatag
116281 ttatacttat tggactcata ttattttat ctagcggtta taagttggta ttgggtaagt
116341 attatgatga tgtagattta aaaatactat ttaccatatt tggtgttggg attgcattac
116401 tacttggagg atttatatta taaagcagga gctattttat tttaaggaga ggtaaatatg
116461 aattatagag attttattac agattgtatt agcggtggtt acaacgtaca catcagtgtt
116521 acagaaaaac gagtacacat tatttctgag atgacatcag catcttaccc taaaaaggaa
116581 attaacttag atgaactaca agcttatgtg tactatatga ataatttttgg aagtcaaatt
116641 acaacggagg ggttataaat ggaattggtt attaatattg tagcagtatt ggttggtatg
116701 tatgctattt atttctatgt tacaaagttt agtactggct tatcaggtat tttaattgtt
116761 ttagggatgg ctattggtct ttacttctac ttagactatt taaatgtcag agaaaatgtt
116821 attcgattag tttcagtaat gttcggagct ttcttattta gtattgaaat gatttataat
116881 aaaattatgt tcgaaattaa aaaaagcaat gttcagaaga ctgttagagt gtatgataaa
116941 gagcagtaat gattttacca taagagtacc taaattactt taagtgtctct ctatggtacc
117001 ttaaagtagc ttagaattga aattaaggag atgaacaatt atgtatcctg aaatagatgt
117061 ggaagaatta gcgtataagc taaaaagtac aagagagtat ttagagagca ttacaacaaa
117121 agaagtagaa atttatgaaa tctatcatct taaaacaggt aagttagttt ttaaaggtga
117181 atacattgag gtaaaagaat tactgaggaa aatgtataaa gaaatttaa cacttgtaga
117241 tgtagataca atgttaagca ttggtaaagg atttattgat gtaattaaga atatatcggc
117301 agaaaatgta ttccaaataa catataaaaa ggagctatca acaaaatgat taaatattt
```

Figure 17 (contd.)

```
117361 tcagaagtag ataaagaata caaacctatt attactgaaa agtttcctaa tggtgagatt
117421 aattttaaat atgatgattt aaagtattta gtagaagagg acttaagatt tgatgtttc
117481 tttaaatggg aaaatgacgc agacttaatg catttgtata tgtttactaa gtatttagag
117541 caactaggta ttaaagataa agctgaattt ttagagattg catatctacc ttatagcaga
117601 atggatagag tagaagaagg acataataat atgttcagtc ttaaatacat tacagaattt
117661 attaataacc ttaattataa atcggtatgg gtagcagaac ctcatagccc tgtaacagaa
117721 gaattactta ctaattcttt tgctattgat gttacactta aattattaaa tcagtatatt
117781 gaaatgtccg aagagcctgt aacaatagta ctacctgata aaggggcata cgatagatat
117841 ctatttgatg tagaacgtat cttaatggaa tctaatattg aatcatattc aattgtatat
117901 ggtgagaaga aacgagattt tgaaacaggt aagattaaag gtattaaaat aattaaagat
117961 aaaaatactt tatatgataa ttgtattata ctagatgact taacaagtta cggtgggaca
118021 tttgtcggtt gtaaaaaagc ccttgacaaa cttaaggtaa gtagtgtatc attaatattg
118081 actcatgcag aacgagcttt tgcagaagga gcattactta gtcaggatt taaagatatt
118141 attgtaacag actctatgtt ccctaaaaat aattgggaaa aagctattgc taaacataga
118201 gctagaatca acggaactga attacaaata aaagatatcg aaagatattt ataaaaggag
118261 aaaaataaat tatgctaaat ccaactttaa tgtgtgactt ctataaacta agtcacagag
118321 aacaataccc tgaaggtaca gaaattgtat atagtacact agtacctaga agtaataaat
118381 attatgaaca cagtgataat attgtagtat ttggtattca atcacttgtt aaaaaatatt
118441 ttattgatat gtttaataaa gagttcttta acagacctaa agaggaagtt attaatgaat
118501 acaaacgtac agttaaattt acactaggac aagaaaatcc tgatgctaaa cacttagaac
118561 aattacatga cttaggttat ttacctattg atgtaagagc tttaaaagaa ggtactgttg
118621 ttcatcctaa cacacctgtt atgacaattg aaaatactca ctcagattc ttttggttaa
118681 ctaattacct agaaactatt attagtactc aaacatggca agcaatgact agtgctacac
118741 tagcatatga tatgcgtaaa atgctagata aatatgcaat ggaaacagta ggtaatattg
118801 aagcagtaga tttccagggt catgacttta gtatgcgtgg tatgagttct ttagaaacag
118861 ctcaattaag ttcagcaggt catgcaatta gttttaaagg tagtgataca gtacctgtag
118921 tggatttctt agaatcatat tacaatgcag acgtagagaa ggaaatggtt gttgcttcta
118981 tccctgctac tgagcactca gtaatgtgtg caaatggtaa ttatgaaacc atggatgagt
119041 atgaaacata taaacgtatg ttaacagaaa tatatccaac aggcattttc tctattgtgt
119101 ctgatacttg ggactttgg ggtaatatga ctaaaacttt acctagatta aaggatatta
119161 ttatggaacg taatggtaaa gtagtaatca gacctgatag tggagaccct gttaaaatta
119221 tttgcggaga ccctgatgca gacactgaat atgaacgtaa aggtgcagta gaagtgcttt
119281 gggatacatt tggaggtact gaaactgaaa aagggtacaa agtattagat gaacatgtag
119341 gattaattta tggagactct attaactatg aacgtgctca acaaatttgt gaaggattaa
119401 aagaaaaagg ttttgcaagt attaatgttg tattaggtgt aggtagtttc tcttaccaat
119461 ttaatactcg tgatacccac gggtttgcaa tcaaagcaac gtatgctaag attaaaaatg
119521 aagaaaaact tatctataaa aatcctaaaa cagatagtgg taaacgttca cataaaggtc
119581 gagtagctgt atataaagac ggttcatggg aagataactt aaccttacat caatggctaa
119641 acaaacaaaa tgttaatcaa ttagaaagag tatttgaaga tggtaaactt tatagagacc
119701 agtcgttaag tgaaattaga gaaataatta aaaataatta ataaatattt aaactcccta
119761 ttgacaaagg gagttttta ttatatagta gggctatagt aaataaagga gtgaaagaaa
119821 tgatttataa aatatcaaaa cataattact atagtaggtt tgaatattca tcttatttac
119881 ctgatgaagg attgcatat atagattatg tagatgtcat tcttataggt gtagataatc
119941 caaagaagag aaaagttatt actttaaaag cagatgagtt taatcctagt gattttaagg
120001 ttggtcataa atataatatt ataaaatac tatggtttga gaaatgggaa tggttacagc
120061 catagggagg agaggtatac aatgattata gataaattaa atggagttaa attagagatt
120121 ggcggtcatg ttgtatcatt tagtgtaagt aagtttaaaa cgattaatgg tgaaagacaa
120181 ttacttgatt accaccatat caaaagaggt aaacagagat attttagaac tactgaggaa
120241 ttctataatg agtacaaaga aataaaaccg gataagaatg agatagatga aatgtttgaa
120301 tctttaggtt acgtaaatac tgaattagaa gatgtagtaa gaaaccaaga gaaagtgaca
120361 gagatattag gagttagtga acagtattta aaccaattgt cttataaggc tatagaggaa
120421 tatgtgagaa aaatagttat cttagaaatt aaagaattaa aaggagagat acaatgataa
120481 acattaatgt aactgaaaaa gaaaattag ttgtaggtga tttagtaaaa tcaagagaag
120541 atggtacatg gggtattgta gtagaagata agcaagactt aaatgtagtt gtgttaaatg
120601 acgagccctg gttatttat aaatcaggaa ttaaaagagt agaagggcaa ttagaagagg
120661 actttaaatt tattaaaaac agagaagagt atgatataga tgtagttaat tcttcttata
```

```
120721 aataaattca catctaccta ttgacttagg tagatactta ttatataata gtatacaagg
120781 agatgaagta tgatgaatgg aaaacaaatt tatgtatttt taagtgacca atacagtaaa
120841 gatatactca gtttacaatt aggtcttatt aaggaatggt ctaggagaga actaacttat
120901 tcagatgatg tcggttcaga tgcagatgtt gttatttgta ctgatatagt aagagatgat
120961 ttcgtaaaaa aactaagtaa aaataatagc aatgcattat ttgtatttat tagttctagt
121021 tattggatag gttataaagg cggagaattc tttgttgcag ttcaagacta tgtgaaaggt
121081 atgtaagata tgaaaaaatt attaatatta tttacattag ctagcactt actattagca
121141 ggatgtacac cggataatca tgaaggaaaa gttttaggaa caggagaata tagagagcca
121201 actacttata tcaagtcagg aagtgttact gtaccagtta ttggtgaaat gaaatactat
121261 gtagacttag aaacagataa aggtgaagac cgtgtttatc ttaatagga agtttatcgt
121321 aaatttgata aaggtgatga tttctctaat gtaggtaaaa aagtatataa aaatgatgaa
121381 ttaatatata aaggggacta attagtatga aacaatttat acatgataaa aaagatagtt
121441 ataatagtac aaatcgtaat tttgatattc aatattataa aggtatacct ttacaacaaa
121501 ttgataggg gtatggtcaa gcaagagcta ggagatttac aataaataat acgaaccaaa
121561 atatatggat acctatgaca tatttaaaac ctaatggtac tcttaaaaat aacattgata
121621 tagattggat acttgttaaa gaaaaatgta gtttaaagaa agcaggatta gtaataaaaa
121681 tagaaattac aggagatgta ttataatgta tatattagaa agaacaatta gaggttttgc
121741 aggtcaaaca gaagatattt tacctttaaag gagatgaatt aataatggag tatgaaaaaa
121801 tgattagaga aataatggta aactctaaag aaatgtcact agaagataaa aaacatttaa
121861 tgagtttatt gatgagtgct tatggtgact tatcaatact agtagctttt gaagaagaaa
121921 acacagcaca tatgtatgaa gaaataaaac agtatgatac taaaaagtta ctgaaaccaa
121981 gtatggtaag taaagataat tatatgaaat aatatgtaac caatcaggag gaataactaa
122041 tgataaatat agaacatgat tatacaataa gaactgtaga taatagaaag tatacttact
122101 atagtaaaca tgaatcccca gttactttat ataaaaatat taaagtaaa gattgtattg
122161 aagtaactaa atatgggaaa gataaaaaag ttattatagc tactaaatat attgtatcta
122221 ttgaacgatg gtaattacaa ggaggagtag ttatgaatgc tagggaagca cgtaaaaaca
122281 ctaaaaacta taaggactct aatgtagtaa ctaaagagca acacttaact tatatctata
122341 ataagataaa ctacttgatt gcaaatagta gtagtcaggg taagacatat gtggcaatga
122401 atctaagaac agattatcct gatgagtttt ctttatctaa attaaaatat ctaaaagaaa
122461 ttaaacagca ctataaagac ctaggattta atgtgaaaac gcaagtaaga aaggcaaagt
122521 ggtcagagaa aagtgtaatc aggtactact ttaacttagg ctatatagac agcgtgttag
122581 tacctattat acacattagt tggtaattac aaggaggaat agttatgttt tttaaaaaga
122641 agaagttaag caatgtagag aaacaaataa gacaaaaccg taataaagaa gacaaagaaa
122701 gaaaagaaca tcaagataag ttaaatacag atatgtataa aacgtatgaa ttagataaaa
122761 ttgtagaaga acatttaaga aaattagaca atatatccct tgaaggatta gaactaactt
122821 cagtgtgttt agggacaaga cttgtttatt attattcaat aggcaaggat tgggataaac
122881 aagtatatag tttaaacgaa ttagaatata tgaagaagaa atttaagaaa ctaggatttg
122941 aaactcagat aacaaacgaa gatataaggat ttcaaccta tatttattta agattattat
123001 gggatgcata agtaattatt attagaggag gaatagttgg tgttgcacag ttaattacgg
123061 attatcatga cggacattaa gtattgaata ttgttgacta ataataagaa gaaaatatta
123121 ttactactaa gtacctttgt tatgtactac tattactact actaagtacc ttgttatgt
123181 actactatta ctactactaa gtacctggga attctttac ctctctcact cagcctatta
123241 cttattaccg acttcctaa ctacttattc tatagttata atattcattt attatacaat
123301 acttaaacta tagtattcta ctgttaatct atgctgaagc ggtcttaatc tatggttatt
123361 atataataat cttatataat ggtacattaa tctagtatat tacattagaa tcattctaat
123421 ctaggattt aatcttttaga ccctaggaaa agtggtacta aaatataaaa ccctataggt
123481 atgggattct tattttttaaa attactaaaa agtattaggt tttccctagg gcaaagtttt
123541 aatgtacta aaatagtaag tagctactta tcatttaggg ttctataatt gagaatattg
123601 agagataatc cgcttcaatt gtaattaatt gttgacaact atgaagcggg tatgctataa
123661 ttaggtatag tcaaatttag gagatgaaat agatgattga tatatactta ggagaaggtt
123721 ataataaaga atactgtgtct aaagcactca gattaatcaa tgaccatgct cctagggagt
123781 taagttatga ttttaataat gtagaagcgg atgttaatat tcacacaatg ttatatgtta
123841 aacctgaaga tagatttata taaaggata tatcctatga cttccccgggt gatttaatta
123901 tttgtatagt tgatgatgat gctattgtat accaccaagg tgagcagatt tcaggtatta
123961 gtattttaag aatactagaa gagatatttt aaggaggata agtaatcatg ataggaataa
124021 caatattaat tacgataatg agtatatcaa ctatctctat gtatatttat ttttagtag
```

124081 acttgattca gtcaatcaga tataatagtt ttgataaggt aattaacgtc ataacatttg
124141 tacttatgac agttataata gcatcaggta ttttagctat acttggaata tagagctcat
124201 ttaagaagcg gttaagtagt tagaggggat ttgtcctaaa atagtatacc gcttctatat
124261 ggaaggctga gaggtcttag aattgaaagg agagatataa tgattcatat attttaact
124321 gatagttatg ataataaagt tttaaatact gtactcagat atattaatac tactagtgat
124381 agagagctta gttacttaat gggtaaaggt gaagcggatg tatgtataga aaagggagta
124441 tttagtaata tagaagatgt taaaattgac tctgagttta ttgatagagg taacttatgt
124501 atacttataa atgaagatgg attagtatgt agttactaca gaggagaatc atgtaatgtt
124561 ggttcctttg taaaggagag gttataatga tagaaattag gttaactgaa gattataatg
124621 acttgagtct taaggcatta ctaaaacgta ttaaaagggt agctcctagg gaattaactt
124681 atggtttaga agcggatatg gatactacag atgttaatat tggagattca gttccttcta
124741 gaggtttata tgtagagtac tcagaacgtt ttactaggga cttatggata attgtacacc
124801 cttcaggtta tgatgcttat tatcaaggag agaaatatgg tggagagtct ttagatgaga
124861 ttatacatga tatgttttat gattatgcag acccttttga cttagattat tagaaaggag
124921 agattataat gatagagata taccttagtg aaaattatga taagaattta ctaaaagcag
124981 aattaaaatg gattaaagag accgcttcaa gagaactaac ttatgatatt aataggaaac
125041 ctggattgga tgtttatgtt aatccctata ggtgtactaa agacgaagtt gaagaatgga
125101 gtacacttcc tccatttgaa gatgatatac ttgtatttat agcggagacg tggatacatg
125161 aatatcttaa gggtgaatca ataggtgtag atagtatgga agagtatgta aaggagatgt
125221 aactaatgtt taaggtatat tatacagtct accatagagg tagtatgaaa actattaagg
125281 ataagctaga tagaagtagt ttaatatact tcttgtatga tacttggtat aaagatatta
125341 gtaacgtatt ccctaatcac tataataaag agtttgggag taagagtgat gatatagata
125401 tagataaact tattgaagcg gttaatgagg aaggtatatt acttatcaat agaggtaatt
125461 atgttacaat aagagaatgg taggatagga taaacttagg atagaaaata atttaggatg
125521 agttacaata ggataggata ggatagggg ttaagttagg atggatactt taacatacac
125581 tattattcat aaagaatctg atagggtaat agctagcggt ttaatgagaa cagaaactat
125641 gaacttagtt caaaggatga taaatactaa tctagttact gatatatcat tagatgatta
125701 tatacgcaga ccacatggaa agatagatgt agtcaattta ctagtagata ttagaagaca
125761 aggcgtattt gatttcaatc acatttggca cgtaggatag gagggatagg atgatagtta
125821 tatatacaga tgtttctaag gattattttaa aagacgagtt cttaccttgg cttaatgaaa
125881 gggatagata cttagaaatac tataaagatg aattacctga ggatatagat tcctcttata
125941 ttgtatcagt tgtatactgt aaggatatgg aaggtctatt agaaagaaaa gacattgttc
126001 ttgataatag ttataatgaa cctgtagctt tattaggtgt tcctgagttt tttggtaatt
126061 atagtaatta tttctattat agaggagaaa gtattagtaa acatgaccta ggagaaattg
126121 ttaggttaaa agcttggcaa cgtatgggtg gggattgact aagtagctct ccctaatttc
126181 actaagtagc tccctaggaa ttgcctaagt agctcggtat gattttaccc taagtagctc
126241 cctctgtttt ctactagttt attttaaccg cttcaggtgt ctatatatat atagacggtt
126301 ggaataatat cagaccgcaa aaataaatac actaggatat tattcccagt gtattatata
126361 atttttttat agaatattta taacattgta ttcaaattca tttacttcat gttgtgattt
126421 aattaaattt ttaattaatc cgtttgtgt tttatactct tttattagtt tttcattttc
126481 tataattaaa ttattaaatt cttcttttgt tgtttcctca tctacataaa atttactttc
126541 atatatttca taatatttt tatctgttcc gccatctaaa tcatctgata tttgataatt
126601 tttgaatata atttcttttg ttctaattc atttactaat aattgtgatt ttgcatattg
126661 taatacatct tcattgtccc acattggaat atagtttatt ttcatttaaa tcaaatcctt
126721 ttcttataat tttttatat aatatttgta gaagcggttg gggtttgtcc cttgccttac
126781 tacactttat atattacagt atagttattc agaagtcaat actttgagt aactttttt
126841 aaattctttt ttcttctata taatagtagt tttagcccct aaaaatgttt ttaaaagaat
126901 ttgcattttc ttattgactt tattatcata tggtagtaat ataaggtac agcaagggaa
126961 cagcaacaag atattagaat tatataaaaa aattatttaa tttgagatga tttaaatgga
127021 tgtaaaagaa attgcaaata ctataatgga gttgtggcaa atggacggct acagatgtgc
127081 agaacctcca ttatatgaaa gcacactaaa ccacacacgc acacacacgg cgttaattgt
127141 ttctattaat ggaaactatg acacagtgca gatgttccgc aaaacgccta taatgagcat
127201 gagagggcaa agccaaccgg ctagcatgtt agttaatgtg attgacgatg taattataat
127261 cgtatatgaa aatgtagtgt acggagttca aaacaaagaa ataaaattta ttgaagaaat
127321 taaaaaatag gggttgcaat cctcaagcat ctatagtaat ataataggtg tagggggatag
127381 caacacacct caaaa

Recombinant NanoLuc® K phage (127929 bp) (SEQ ID NO: 14)

```
   1 ggatttgatt attatgacaa atacaataca agcattttta caaggacaag aagcaagcac
  61 agttaaggac gtagcaactc atggagtaca aagcggagca attggcaaat taatctacac
 121 atcagacgta gtaaacttct ttgatagtta cgagcaggac attgaagcgg tcatcactga
 181 atacattgaa gaggttacag gacaacaata ttatgactta ttgaactatg agcttatgag
 241 agacctcgag aattatgcaa atgtagaatt tgaagacgaa gacgaatata ataacattca
 301 atttgaccta gcagaaaaca ttgcttctga tgaggttgaa ggatttgaag acatggacga
 361 agcagaccgg gcggaagcaa tctatgaggc tatggatgat gttgaattag aactacaaga
 421 aactgacaag gttcaatatg ttaatctagc ggttgagatt gtagctcaaa gaatggcact
 481 atagaaagca cacagagaag cttaaccgct tctctaatac aattaatcag gagatgttga
 541 agatgaatac aagacgggta aacagagcgt taaacgaagc agttagatta ttagatgaac
 601 aaatagcaga tactcaaaag actatgcagg agttgaataa acaactagag aagcaaataa
 661 aggctaagca agagctaatg gtattagttg atgttatgaa tggtgatgat gagtaatgaa
 721 cattagagag gttcacaatg tcgttaagag tgctaagagc aaactcctgc aggagcaggc
 781 tcacccaacg gataacctca tagagcagta catcaatgat gagctacaca gacgcacaca
 841 gagaagcgga acaatacaga tgaacaataa tactacttca tatagtaata gcccatatgg
 901 tagcttagaa gagcttagag aagcttatga cctatcgtca ttatctactg gtgagattaa
 961 agaactaata caaacatttg tttaaattat tttatcaaaa cgctttacaa tctttttagtt
1021 tgtatgatat aatgaactta acaaattaaa agaaaaggaa atgatgaaca tgacaaactt
1081 acaagaaaga aacaagaat tgaaaacgtt actatttaac ttagcttttag agaagaacaa
1141 agcaactgat gagacactgc ttagcgtatt agagcaagca catcaagagg taggaaatca
1201 attaagaaaa gtaagaaaag aaatagaaat tttagtagaa gaaaaagaaa gggaattttg
1261 gaatgatatc gaatttaatg gattagacta agagggaata aaatccctct tttattttta
1321 tcctattata taattttttt atattatacg ggggcagggg taaaatgcca ctcaatggggg
1381 gtgggtctat ataccccctat ggtctaccca ggtacttatt ttttggggaa aattatgaaa
1441 ataaatattt aaaagtcaac acctaaaata tagaacgtaa gtcaacaccc tatattaaaa
1501 gtcaacaatt tatagtacaa atagagaacc tctaaatata aagtcaacat atctaaaata
1561 agaaagaggg aaattaaatc cctcctctta ggtattatta caacctcta attcatgtat
1621 agtaatcata tccatcccat agaaatctct tgggtctcct ttaatgaact cttgctctcc
1681 tctatggttt gtttcctctt tataaccttc ttctttaata cgtttaatta agttctcctt
1741 atctgtatat atcttatctt ctctaaaatg gaagttatct tcataaggtt cacaattatc
1801 atgttctact tggtatagtt tcattagtca ttttcctcct cttcgtaaga ccatgtacca
1861 tattctgcat tatagtgtgc tgtatctgcg ccttcatctt catattctac actataccat
1921 gcatcctcct ctgtttctgc atctatatat cttaccctctt ctgtagtaat agtacgtttt
1981 acttttgtatc tcttcaactg tttttactcc tttatatttt cctctagtat ttgttttaat
2041 gtctgacagt ctttttggtc tagagtatcc caactctcta aatttgtaa ttggtatagt
2101 aactcattta caatttcatc gaaggcttct gcttttttat atacttcttc tagttctgtt
2161 tctgctaatt ttctattcct tttaatttgt tctgctttag ctactaagat atgggcttta
2221 ttcatttcct ctataataaa gttttatag ttttccatta ttatttatcc ctcctatttt
2281 ctatccgttg ttttatctct tctctattgc ggtggtgctc cttactcatt tctttacgtt
2341 ccttatttgt taaccttatc ctataaacaa ggtagttaat gtataagata ccggctgacc
2401 atagtagcaa gaatgatatt aaataagtcc atgagatact aatttctatc attgtgagtc
2461 ctccttatat tctttatagc tcttaatggc tattttacaa ataactctat ttacagcaac
2521 aaatactata aatgataata gtgttataac tgctcttaca tccctgtaa aaggtaatga
2581 ttgaaagagc aaatagtttt ctaaaacact aatagctgta atagtagtta gatataatat
2641 agataataag taatccttta attttagttt aacaaatggt ttttgtgct cacctgttct
2701 tacaatacca taaagtatta tgaaccacat aacaggtact aactgtataa taaaatcatt
2761 gtctacattt aatgcatgta gagcgtaaat aataactgca ggaatacctt a atgaatgc
2821 tagaaataca taaaatataa ttaacattat aggaagggct acaagaaaac ctagaccttg
2881 ttttgaatac tctaatgtgt ttttacctag gaacttaaaa aatgttttat tcatcttctt
2941 cctccttgga attactttct gtaattgtaa tttctaacat attattgtaa taatcattct
3001 tttgattgat attatagtta tcattgtatt cattaaagtc tacataaata tattcattng
3061 cgtcattttc ataaataata tctatagctg taatatctga atatgctgta atcatttcat
```

```
3121 aagcgttcgt attatcagga taagcaaaac caacttgagg tatttccata ggcttatcaa
3181 taagaatacc gaaataagta cagtgacgtg ttcgacttat acttgaagtc cctttatatg
3241 taccatagta atctatacct tctgtaatac ctgatatatg gaacctgctt acgtctttag
3301 gctctaatct tacaacatcg caattctcta atactaaatc aatatatttg atattcattt
3361 taactctcct tttatattaa taattttttc cattctttat caaccttttt aagttctttt
3421 ttattatagt ccccgtcttt agttactaca gtgttccatt ggaacttttg taataagcta
3481 aaattattta taatccatat attacttttta ctataataca tattgtcttc aaatcttata
3541 tcttttctta taaaatattt atatattta tatctttctt catctgcacc tgatatttta
3601 ataatttcat tagtatttaa ttgagtggat aactggaaga taacatcttt tactttcaat
3661 aggtctttaa cattacctct gcctacatgg tcattatagc aatcatattt aactttttc
3721 tttgttttc tatcattaac tacaatgaat atattatata cgatataagc tttaaaatgg
3781 gtataggtag taggtgcttc tgaatcatca cattctttc ttaggtctgt acattgtatt
3841 tttaatgtaa tattatttga tatgttaact acagtagagc cctcatgttt tttattaaga
3901 tttatcttat ccatttata attacctact tattgtagat acaatgtact cgaacatctt
3961 ccattacttt gcctaataga ttctgacctt tccagttact ttgctctaat attttaggggt
4021 catttgcttt aagacctact ccccatatt tatcataagg tgaagcttct acaaaatctt
4081 tacgtacatc tgtgtctaat attcttgct ttaggtgtgt agtcataaat ttatctttaa
4141 ctacttctac cataatatta tatcttactt tattccactg ttcttcatta aaattacgaa
4201 ctttacgacc taaacttta gcatggtttg ggttcttagc attagttat tcacctgcta
4261 tttgaaagtc attaaagtat cttgctttgc gccacataaa ggcttgctct gagttattaa
4321 atgttcttcc ttggtgttta aactttatag ggtagaaatt agaataaata tcctctttac
4381 cccaaaacat aatatattcc cttgtttctc tcataatatt tctccttaa ttccatagtg
4441 atggtaatac aatttaaaa ttatctaata tttactttg tacctgttca agctcatcat
4501 atttatccat atcaaaatca tccatttctt tatgataata tttattaag cttaaaatat
4561 gttttatcat atctatttgt gttctttctt tgccgtctac atctacaaaa gtatggtatt
4621 ccatatccac atgattacta ctctctataa atgcatttag gtcagcgtat agctgaataa
4681 aaaaggacat gtcataattc caatacttag gttcatttct acctagtttt ttcttcattt
4741 tcttatattt ttattcttt tttatcccaa aaacttcttt ttcaaagtca ttcaatttaa
4801 gaccttttaaa atatttttc ttcatttctt aacctccaat ttaataaatg gaaaatcaat
4861 gtttctaaat actgcgccaa catcacacat taacatgtct ccattaattt ctacttctcc
4921 actgtctgta ggggtgtgac cacatacata ggtaaaacca tcttttctag gttgaaagtc
4981 tcttgaccat attaattggt caattgtttg ttcttctaca ggtttccaac taaccccacc
5041 tgaatgagag aatatatact tgtctctctt atagtactt ctacaattaa ccataagtat
5101 tttaaatttt ctatagtcgt ctgattcttt aagtttcttt agttcactt taataaaatc
5161 ataattattt cttagatttt cctctacact actatatttt aaagttactg tactcacacc
5221 gtaagagtta agtgtttcta tacaatatct tgagagccat tcaatatcat agatacttaa
5281 tcggtctacg ttttccataa tattataaaa ctcatcatca tggttcccta acagagttac
5341 tacattatca tcattagaca ttaaatcaaa tatatagtta acaacatctt ttgaccttt
5401 acctctatct acataatctc ctaaaaatac tattgtttct tcaggttttc tttcattatt
5461 tatttatcc ataattgtta ataattttg gtattctccg tgaatatcgg gaacaacgta
5521 tatagccatc taatctcctc cttattgtat ataactatct taccatactt agtaaaaaaa
5581 gtcaataaaa aaacacctat taaattaata ggtgtttatc atttaatgtt attttaaagt
5641 atcattacca tgtgctaatt ttttatcatc tattgcatgg tcattataaa tatatttaac
5701 ctctatatac tggtcttcac ttttcagtgc atctactata gaagcattat tagttattga
5761 gcttgttcta gggtaagtaa atttttgacc gtcagataaa ataatagtaa catcaacttc
5821 aaagttaaca ggtagtctgt atccataatc ttccaaataa ttaataaagt tattaagaga
5881 aaatggttta tacttgccat ctaaggtata gtcaatatat tcatttaatg cattagtaag
5941 ttctgattct gttaactcca ttgtatcata atctttttcg ttatagaata ctacaacatt
6001 aggtgttct atactagaat ctccgtcttt atacttagat ataaaaaatc caatatttcc
6061 tttatgctct aaataatctg cttcataat tttaagtact tcttctgcta taggttttgc
6121 taatagtgtt acccattcac cttttctgc gtcataaaca ctaggtagta cgtttaccat
6181 catttaaatc tcctcttctt aatttattgg tttaaaccac aatttactct tatcacttgg
6241 ttctgtttca ctaactacga aagagttaga atcaatgttt aaagtattaa aaacaatttc
6301 ttgtttgtct tcattacttt ttgttgtaaa ttcgggaaca tctgttaata tagactcttt
6361 accattaata gtccatgata ttttaaagaa ccccttggcta tacactgtat tcggtgtcag
6421 tttttcaatt ataattttag cggatgcacc tgtaattttt tctgaagatt ttaataattt
```

Figure 18 (contd.)

```
6481 acctttggaa tcatataagt ttaatgttct ctccacaaat tttatctcct ttactatatt
6541 ttgtacaatt aatataacaa aaaaacacct attagtttaa ataggtgtcc gacagagctc
6601 ccgtacttag attacggtta ataatatttt acgacaacta tatgagaccc tctgtcgttg
6661 aaactcttgt cactgcgtta ttccacaaga tatttagaa ggtagcttgt ggaagaagat
6721 tgtttttaaa ggtacaatta gcgttttaa gcctattcga tacccaggac actatgtccg
6781 tactaactat tacgtcaata aaggttctac ggtctcaatt acctactctt tattgttaaa
6841 actaaaatta agcttgagtg ctctagaagc caaaatcaat taattaacta tagatacgga
6901 atggaggggc actaccatcc ggagtctacg gtcagataca aagcctctgc cgggcaacat
6961 acggtatctc tcgtacatca ggttgactag accttttagag tttttcactc cttctcttat
7021 aaccagtaac ttaagagaaa taggttttac ttagtagata tgaaacaata aatccacata
7081 caatattaaa tcatagtcaa gtgattgcac atatgtctaa cacctataag ttttttgcta
7141 gcctggtata tggactctgc aggattcgaa cctacagtca aaccgttatg agcggttggc
7201 tttaccttta agctaagagt cctagaaata tcctgagaga ggactcgaac ctcaacgact
7261 aggtagctac atctagccaa tgccattact caggattgct agtaacgcta aatagaatta
7321 taacgttacc gtagaccttt tctacgcttg gtagataggt aaaatataat gatttcaaag
7381 tacccatata gttaggctct tattctcatt ataaggttaa aaaggctaac tgtgtttagc
7441 attatataag aggctttagt taactactat actaataata taccataaat tatacttaat
7501 gtcaagttaa tttatcaatt gaatctataa tttttgatgt gctacgtata tctgcttctt
7561 tactatgttt aaggagatat tttaatttca ttaaaaaaga atttttttct ttttctataa
7621 tatcttcttt atcatcatat tctgaaaaca taatgaattc tataacctata ctatttctat
7681 tatgtgaaaa catatttata gaaaaaggtg aatcaaaatt tttatcatct ttattaatac
7741 taaagtcttc agtaacctgt aagtcattta tttcagatat tcaaagtaa ccattaactc
7801 ttttaagttc aatataacta ttgtatctaa agtaacgttg ttcttctatt aactctctt
7861 ttgttatata aggatattca tttatgaata taggattact tgttccatag ttatctctaa
7921 tatattctgc atcctctagg gaatcagtat aacctaaaat ttcataactt gttgtataca
7981 ctgtatcttc ttcccacaag tcatagtcca tttcctctat ttcttcttct aatatataaa
8041 ttttttttcat atattactcc caaaccccga taagatttt aagcttagct ataacctctt
8101 cttctgtttg ataagaaaat acccctgtaa tatgttcata gttacctaca atttcataat
8161 cttgtgtacc atgtttatct actaagtatg agttatttcat aacatttaaa ctatctctg
8221 agtaactaaa atttatgtta tagtctacta aaaaattaat aatattttc atttacataa
8281 cctctcctat cggatattgt cctagcattc ttgttccatt ttcattataa aaagtatatt
8341 ctactacaat aatattcatc atatctacat atatagcttc tatatacggt gtaatatttt
8401 cctcttcttg tatgtgttta cctatgatat catataataa ttctgagtgt attcgtttat
8461 ctctcattat agacctccgt aaggaattct acagttttgt ctttcaaaga ttttctact
8521 aattccatag catctttata gtgtttgata ttagattcat tagacttaag tttatctttt
8581 acttcttgaa ttaggggctc tactttatta accaaatctt ttttcttttc aatacttaca
8641 ttgcttctct tattgtctaa tactctttt ggcatatatt taactttgc aaagtcttta
8701 tagctaacat ttaagttatc taaatcatct aataaatcat tatagtattc taaatgatta
8761 tagaatgtat aaaacttaac aaggtcttta ccagttaatt ctccttttt tagtatatta
8821 ttaatattac cgataacaga atatgctata ggcttaaaat tagctctaac ataagttaaa
8881 aatataaaat catcataaaa taaatctaaa acagttttat tgaatctagt atttttagct
8941 tgctctaatt gagcacataa attaagaaca ttatcaaacc cactttttag aactaaagag
9001 ataaatcttt ctactgcata gtatcttgat acttctgtat gcttacttgc ttttcatta
9061 ttcctaaata tagtatctga taaaggttga acaactaaac tcatgtaatc tttatctgaa
9121 tgctcatctg atgttccttg ataagtactt ccaaattcta ttgttgataa taagaaactt
9181 ttttctaagt tcattataac atcctccttt tatttgttat ttaaataata acatatattg
9241 ataataatgt caatactttat atatctttctt ctgtatcaac ttcatcttgt ttatacttaa
9301 agtgttcata gacttaaat agtataatcc ctagtgttat taatcctaaa atatatttca
9361 tagcaatcct ccttaataac catgtttagt tacccaccct gctaaagcat ccatagctat
9421 atcatattct tcttcatttt taattcttat aatttctct atttcttcct ttgcttgctt
9481 agaactaata aaatcaatat cagtatcctc taggttagtt aattctaagt tttctctaat
9541 aaaattcttt tgacttggtg ttatagaatt aactcttaca tttcgtgat ttagaaattg
9601 gtagaagtcc atattactca tccttttta cgtattctgc catatctttt aaaatactta
9661 gtacatactc taaatctcta tattggtcat ctaacgaacc tataatagca tatggtgtca
9721 tatcccaggc atgtgcacag tcaaacccta atactctctt accctcatag tcataatcat
9781 cgtaagtgat acctctatgg gcacgtcttt ctaaggagtc atattctttt tcattgatat
```

Figure 18 (contd.)

```
9841 ctgaaggtaa agttatatat ccatttagat gaccagtttc agggtgtctc ttaacagtta
9901 gtttaactcc tttataataa atatcaagac ttaaatcttc tcctagaata ttgttttctt
9961 tttctacttt ttccataatg tattgaggtg cttttttaaa cataattagt catctccttt
10021 ttatttatat ctttactata cactattttt tatattttgt caacaaaaaa aggctactaa
10081 ttaaagtagc ctaaatatta attatttagc gttataagac caacgccaat aaccattttt
10141 ctgtgagaac tcaaagtgaa aaccatcata gtcaaattca atattatagt ctccatcttg
10201 aagtggtttt gaatttagta caggactatt actctttgcc aattctgcta gaaactcatg
10261 attttacttt tccataggg ttattcctcc taattattct tacagtacta atatatcata
10321 ggtcttttc taagtcattt ttaaaagttt cctcgtaaga actagcgtaa gtaacctcat
10381 aacccactac gttagtatat cctacatata atgacttata attagatttt atcttaatat
10441 cttctgattg ttctagctta tttaagactt cacctaaatc atctgaagaa tagtgttcat
10501 tatctattgt tattgtttta ccttgggtat agatatcaat ttcttgtatc atcatttcat
10561 cctttttgatt attcattatt tgattataag tttctaaatc atcaatgtta tctgtatctg
10621 aacctttac taaccattct cctctcttct taaggaggtc atcaaacttc tcatgctctt
10681 taattatctt ttctacctca cttggtatta acacagccct agcatagttt atatgccaca
10741 tagacatatt atcaataaga taattaacca ttcttataat ctcttttttca tttgccatat
10801 accaacctcc ttatatctat tactaatata agagaaaagc agacttatta aaagtctgct
10861 tctgtaccta attctaatct tctatttttc atatgaggaa tcatttttt atctcctgtt
10921 aatagagata attctctagc tttttcttta gataatgtta gtagtccatt ataattatct
10981 actttactat tatattgtct gactaagtac tctagttcat cttctatacc tgctagttct
11041 cctgatttaa ctccaagtaa cttctatac atgtcataat cttcagaaag acttctact
11101 ttgttttag atacagaatc ataaactgct tgtaaattac cttcttcaat aagtttaaaa
11161 ttatattcac caatgattaa ttctttttca gaaagagtcaa gggtaactaa accacttgta
11221 ttacctgtaa agtcaccttt ataatctaca acaattcctt cagttatttt atctcctaat
11281 tcaatagttc catcttcatt ttctttaaat ttatgagcat cataaacttc tactttatca
11341 cctaatctca aatcttgagt taagttatgt ttaccaataa ttctatccat tacttaacct
11401 ctcctttatt aatagggtct tgtgttaaga acattctaa gttctcttt gtaataggta
11461 accaaaaata tttactttcc ggaattgtaa ctgtatagaa gtcttcatca ttattaactt
11521 tgatgttaac atctgtaaac tcatcttgca ttaaccaatg ggttacagtt aagttatatg
11581 acccatcact aacatatcct aaatcaatat catgtctaaa agccaaatct tctaaatgtt
11641 ctaataaatc gttcttttca ttatgttttt cttcttctgt attattttta attgggttaa
11701 ttaattctgt acaaacaata tcatacaatt caccatctgt aacctcatag ttcttttcaa
11761 ttaatacatc ttgtattttta ttgattgaat ttgtaactac tttcccatat tcttcttctg
11821 taaacttaca tttatctaaa tcaacatctg taattaattc tgcaatccat ttatttaaaa
11881 ttgatactgc cattgttcga gaaataatac tatcgtatac catatttatt taatctcctt
11941 atttaggtga atgtggtctt ctaatgaaaa atcaaaaggc gctacaccat ttcttttatt
12001 attgtttct tttttaagta taacataagt tagtgaaaaa gtcaagatag ttactacaac
12061 cattgataaa agtttaatca ggttttttcat agttactcta actccttaag tttattttt
12121 actttctctt tatcgtactt ataatcttta ctagagtttt cattttttc tttctcttct
12181 tcattaagtt ctctatactg agcttcttct acctcttgtt ctttattatc gttatcttct
12241 tctgcttttt gaattctac attcttacta ctaccattta cctttttct aaaaagaaac
12301 caaagtatta ataaaatgat gagtaaaata acaatgctca atacaacagc ccaaatatta
12361 ttagccatta caacctacct ccgaatagtt ttttacagc tcttaagttt tcagatgaat
12421 cgttatttat atcaattcct acgctagaat caaaaattac agcattatca agtatatgct
12481 ctgttaattt attaccataa ctactttttac ttaccacact accataacca tgattagtta
12541 ggtcaaccat atcaggttca acttctagta ctctaaaaga tattctacgt aagaatgaag
12601 gatttactaa gtaaaaggaa gatttaaaaa catttaatct ttgataagaa tgttttatat
12661 taacaacaaa ccctgttaac ttatcttcat atcctgaatt tgataactta cctaagtaaa
12721 ggtttatact atatcctttt gtttctaatg tttgaatagc acttaacatt atagcccctc
12781 tgtaagcaag attttcaggg tcttccatcc aactaatact agaattataa aatacatcaa
12841 taactttctt ctctgctta actctttgct gagacatcat agaattaggt aaccctttta
12901 tagcattagg tacgtgaggt tgatacccct ccggagctac gacaggtttt cttttactg
12961 acttatccat tctaaataat gcatctgtca ttttttttaag tttaactacc atatcatatg
13021 actctctatc acccttaacc attaagttat aggcttcttg aaaactatga gtccctgtaa
13081 aatcatagct acctgtatct gatgaattat ctctacctga aactctattc tttttttaaag
13141 cagaaaagaa atcaggtaga ccatcatatt taattacatt taattctgag ttatctatta
```

Figure 18 (contd.)

13201 atcgtctacc cattgatttt cctcctattc taatcctaat ttatccataa ttgtatcaaa
13261 gtccattgaa tcttttgatg tactatcaga tttctaggt tcctgcttag gctcttgttg
13321 catacctaaa agctttcttg ttgcttctgt gtatctgtta ccctcaggta aagagctaat
13381 aaattgatta atctcatctt tcggtacaga tttaaagata atactttcta caacaaactc
13441 atcttccatt actccatcta atttactacc attaataatt gcacgcattg agaatacata
13501 aggtaatcct ttttcatcat tctcatgtct taattgttgt acaaagttaa ctaggtcttc
13561 attgcttgat aactgatgtt ccaccttagt atcatagtca aattcaactt gagcaaagcg
13621 gtctaatgta gctccgtcta attgttgtct acctacataa atatggtctg ctcctgttcc
13681 catagtatta cctgctgaca caactctgaa atcttcatga gctgttacac gtccaatagg
13741 gaagtcaaag tatttatttg caatagctga attaagaatt aatagtactt caggaataga
13801 tgcatccatt tcatctaaga agaataaccc accttttgta aatgcttat agaattgggt
13861 ttcatgaaac ttaccatttg catcaataaa tcctgttaat ttaaattctt gagtaattgc
13921 attactgaaa taaaaatcta aatctagagc ttctgctact tgttctaata catggttctt
13981 acctgaaccct gctccaccett ttaaaaatac tggaatattt tggttaacta acttttagtat
14041 atcttggtat ctataatgga agattcctga gatatcttta attgttttt ccttcttgtt
14101 gtaattcaat tttaactggt aaattactaa gttgttcttc tacatattct tcaatttgtt
14161 ttttaacgtc agtaataata atttctctac tctcagttcc tgctttctca acaattgcat
14221 ctacaattgc ttgttcatac ggattagagt ttttctctcc tagtttgtct gccaagtctt
14281 ttgttgtttc catttgttgt tctaccaatc tctctaatct ttcaatagta tcttgctttg
14341 ccatatttat cattctcctt tgatttgtta tacatttatt atattacaag tatttgtatt
14401 tgtcaacaac tttctaaaac ttttttagt tgttaataaa aaaaaatacc ttacacctat
14461 aacttaacat agggtaaggt aattgtcaac actttattaa aaaatacatt aatttaaaaa
14521 aatcatcaat atctttagtt tcatgtgtat ccatatcata cataaacata caattatatg
14581 tatgattatt cattatttct aacatgttat gcatagaagt tgcattattg aattcctcta
14641 aatcaatagt taccgtaagt tcttgaccct cataaagtat gtttgctata taatatttcc
14701 taacacctcc cattgttcca tgagaagttt cattatgatt aagtactctc acacctagtg
14761 aaggtaaata ttctgaaaag taatatttac agaaatatat aaaattgtct gttcttttag
14821 acacgagtac tatctccgta ctttatattt cttctaatc gtacataata tgtttttaatt
14881 ttttgtactt ctttatctac tgcatcettt cttcctaacc ttgtagtata tttacaata
14941 ttaaatatca tagaatcaac aaagccatca taagaaaaat gttcttctag aaaagaaata
15001 acatcettac tacctttata gtgttcaggt aaatgtgcat ctacttgtat attataataa
15061 tcttctaaaa gacctatact ttcaccaaga ctagataaag cgtaacctaa atcatttgaa
15121 tcattagacc attcttaga tactgatagt gcatcttcta taattgttac ttttaattta
15181 tctaaataat cttctacttg agcttgtgtt ttcataaatt cttttgcgtt catgtaatac
15241 cctcctaaat tatataaaaa aaaacaccct gctggctac aagcaaggtg aaaaaggaaa
15301 gatattatgg aagtgtacta tctaagtaca cctcataata taacagtttt cctgctagt
15361 tattacttat ttttaaggt cttcttcttt gacaaacact ccattaataa gcttaccttt
15421 tctgtctttt atctcatcat aagccatatc aatacactct tcaatatcta tatctaactg
15481 taaacatagt actgttaata ctacaaaaat atccccaaca ctatctcttg ttacatggtc
15541 attactttta gcaatacctg aagctaattc tcctgcttct tctaataact ttaacatttg
15601 accttcaggt ttacctgttt gtaaatttct atcttttgcc cattgttaa taagttctac
15661 ttttccatt attctatatc tccttaatt tctgtatctt tgataattag gttatcagag
15721 tcacttgtta catttaaatt atcttcaact aattcatgta gattattagt aatatcttct
15781 tcatacctat aacctacacg aacataagct ttaactctga tatctatatt aacataatct
15841 tcttggaatt tttccatttc taacttcctt tattatatca tattatgata ctattgtcaa
15901 ttaatctgag tagttctt tagcaagttg atactttttg tgtaattctt catataattc
15961 tctcatacct tcatagttct tcatatcatc ttccaagaaa ctaaggtaat ctaataatac
16021 ttttacatcc tcaggttcta aagttataac tggtttacc attaggcaac ctccttaaat
16081 tcttctttat ttattttctt gatatctttt tctaatgctt cttttaattc attaggtaat
16141 ttataggcat caattgattg ttgttgacct aatacataac cattatctgt aatacgtatt
16201 tccactgtaa accatgaatt atctaaatct tcttctaatc ttgctaataa tattaaacaa
16261 ctattttta gaattctgtt agcataccca ccaacacaat gagataacat tttaccttca
16321 tctttaagtt tacttacagt atctgcagga aggaatttta cttttctacc atctttaat
16381 ttataagttt tatcaattat ttttctaat ttattatcat atttagcttt aagttctgca
16441 tcatctaatt gttgtgtat agattgttc tcatctgtaa ctatatcatg ttctagtttt
16501 agtgaaaatg gtgttaaact aacactctct aatgttctat aaccttctct tattaatatt

Figure 18 (contd.)

```
16561 gataaatcat gtaagtaatc taagtaatag ttatctagtg catatcctgt tatacgttgt
16621 ctgtcttgag catctacatc taaatagtgc gtcatctttt tgtaattagc aaaagatata
16681 gataatattt gattcacaat aggtttaact tttaaagcat ctgtaacatc tcttgaatct
16741 ctaaccatta aaaaggtatc gtcaaacaat tggtgtaaat taacttcatt gtgtaaatga
16801 ttatagtgct tatagagaat attagcaaat cttaagtaat taccttgctc aaatttattt
16861 aaagttagta actttttata agtctgtttt gtaagattga aggcttcatg aactttccat
16921 ttaggtttt taggtatatg gaatagtaat gcatttcttt caaataaccc aaattcttct
16981 aagttattta ttttatcaat atttttaaca atatctgtta aagttattaa gtaattagaa
17041 gttgaatttt ctcctataaa aatcctatat ttatctcctc tataatttat atgaccataa
17101 acatctgtat tatcaggaca ccaactagaa aaatcaaaat tatggtgctc taatgtttgt
17161 tctattatct ttattataat tcctctagtt aagttaggtt gtgcatagtt ttttaaaata
17221 acatttaata aaacagataa agttaattca ttcttatatt cactttact aatatcatct
17281 ttatataggt ttaaagttat ttctttatta acaagactat ctgttaagaa aaccttaact
17341 tctcctgttt taacgtcaaa tgaactttta ttttctaaaa cccatttgtt acccatatta
17401 tgtttatctc taatatgttt aacttaaga ccaaaagatg aatagttttc agtacttgga
17461 tgcatgtacc aaacacggct atataattca tctgtcatag cactatagta ctcactagaa
17521 ccttttcta tatcttcatt cataacaata atagatgact ttataagacc atatttacct
17581 tggtctagta catccataat atcattattt aaactatcta ctactttttt atattcttct
17641 aattgtctag attcattcct ccataaatgg tcattacctt ctagttcttt aatttttct
17701 tcaacataac cttttgattg tatacgtctt ctactcttat caccatatac aggaaaatct
17761 tttcttttctt ctctattaga ttcaatatac tctttgtaac ttcttccttt attatcatca
17821 actacaccttt caactaattt ttcaactgtt tcataagggt taccttcaaa gtttgttact
17881 tctttattac cacatagggc taaaaataaa tgtatttctg tggctgtatc aaaactaaat
17941 atatatgaa tatctctaaa taattcttta gaacctaagt taattatatt atttttctttt
18001 ttcttaagaa atacatcttc ttctcctata tagatacatc ctttattaac cttaggtaaa
18061 ttaataattt cttgttctgt taatccttt tgtttataag ttattgccat ttaaaatcac
18121 tccttatttg ttatgtacta atcataccat agtaaataat atttgtcaac aaaaaaagaa
18181 gaacttttta aagtccttct aaatgagttt cgtatataac ttttgaatt ttatttaatg
18241 gttctaaatc taaattcata ataagttttt tatactttct tgaattttta aaattgatag
18301 tatttggcat agcaagagct tcatcaacat cttagtata gcttacaaca tctgaataga
18361 tatctactc ttttacatat agaccttgag ttaaactcct aaatactacc tcattatgtg
18421 ctataacttc ttcttcttt tctatgctca tttataaacc tcctggtcta ctctacacaa
18481 acaagtacgt attctaaatt agttaaagaa actgatttaa tattgtttaa ttcttgtaat
18541 ttcttaattt ccacatcata gttcttactt atagtccata atgtctctcc tgctcttact
18601 ttgtgataat atttatttcc ctctttgata aggtcattca atattaccta ccccccttgag
18661 taataattag cttgtagata acatataagt ataagaacaa agtttacaaa ttcagtagct
18721 ataatatgaa cataggtatg tgttaaaacc atacttcaaa ttaatgaagc taatcctaat
18781 ccaataataa gaaatagaaa tctatttgtt ccttctgcac tttagttttt ataaaaggtt
18841 gttatctgag ttacatacgc aaggataata gtaatagttg ctacagtttg tgttaaggct
18901 gtaaagtcac ttaataaaaa tagtaacagt gagaacacaa taataaaagg tatagagaaa
18961 tagtcctttt ttctatatga agctactaat aagcaaacaa tacctaaggt taaattaaga
19021 cctacagata ctatttgaaa tactgaagca tcagttaata ataagttgta aaaacttata
19081 cctactgtag ctacaattaa ataccaaaaa tagttactaa ctcccttgac actttctgct
19141 ttaactaatg ctactaaacc tggtatatat cctactgtaa ttaatatagc atataatata
19201 cttaagtaat gtgataaatt atccatcttg ttccctaat ttctctaatc tattaataac
19261 ttcttcccat gaaataaatc cttctccgtc tgttagttct aaaaccatac catacacaaa
19321 ttggttcgta ctaaattcag ctctgtcagg gtcattgtat ggttaccat gtccttgtct
19381 aatatccgag cagtagatta atacgggttt atttacaatg ttttcaagtt tatctactat
19441 taattcttct tcagtattta atgacgtttc aaacttattt gtaaaataat taaaatactc
19501 ttctccatta tcatatatat ggttaattgt ttcttctgct tgatgtttca tacctaataa
19561 aataccgagt tctgcaattg ttcctaatcc ttcattaagg atatcaaata caaaatatc
19621 tgattcttgc atagccttaa agtcattagt taaaatacgt tctgctagct tagtttgttc
19681 tgcattagct ttatcattta ttgacttatc tttgtgaggg ctataaggag ttactcctac
19741 aatgccatct acttctttat gttgtttatc tctgtaatct accatagctt catttaggat
19801 atgtccaccc atataaatta ctttgtcttt aatttttatta cccatctata gtatctcctt
19861 tttcttctaa aatttctctt aaaatatgtg gcattttttt cttaattttgt ttatctacta
```

Figure 18 (contd.)

```
19921 ttttcagtat attttctttt tcttcttcca taatatcatc aacaaagttt tgacctactt
19981 gtttcataat tagaccgaag ttttctaatt ctaaatcatc ttcagataat ctatcttctt
20041 ctatagccct aaaaatcatt ttttccattc ttgctcttgt aatggcataa tctgccactg
20101 actcgttctt ttttacttct gttttcattt tttgacgact aaattcttta aactcattag
20161 atactaattt aaagtagtca tcatattctg atttaccatc taagtattta attactatac
20221 cttcacccct atcaggttta actgtcatgt cagattttcc tactaattct tgaatttctt
20281 caggttttaa atcatttaag tagtgagatg gtttagatac tagcaaagtt ttaactgttt
20341 ttaaccctaa atgatgtgca attacattca tgtcttctac tgataaataa acttcatttt
20401 ctttatcata aacatcaaat acataaaaat tgttgtaaaa ttcttctttg tactgaatct
20461 tatgtttgac taaccattca ccaaaaataa tgtattttc taaggctgat acgtacgtat
20521 ttcttacatt tatattttca tgtacccaat cataaaaacc atttaaagtt tcattctcat
20581 ttaattttt tctacgtgaa aaacatacta attcaccatt ttctactgtg aagcttgcat
20641 tacttccatc taattttct tgtacaacta gacctcttc tttaaattta tctagtacaa
20701 taccttatt ttttactta gtatacgatt tcattaatta tcctccttg aattatgtac
20761 tatagaaaac aaaataagac ttacgcttgc taaaaatgct aatactacta aaccaggtaa
20821 atttaaaact gttgataaga ataatgatat tgcacttata acataaacta gaccgcttag
20881 aaataaagtt aataatacaa ttgttataag tttcaccaac caattgttat taataaatac
20941 cttagctaaa taattcataa aaaaatcctc cttagttatt atagaataat tataccataa
21001 ctaaggggat ttgtcaacat attatttac catttaaaat tatctgcata ttgtgcaagc
21061 ttagagcgga aattaactgt aaaattatga aatactgctc cttcataatt tttaaagtat
21121 tccatataat ctccaaaacc tgatttactt tcgttcttta aatctatttg tttaaaatta
21181 ccttctacta ttacagtaga attttttgta tgaaccctg taagaacttt tttaagttca
21241 ctacgtttaa agttctgtgc ttcatttata attatagtag catctcttag atttccacct
21301 cttaggaata gatgggatat ttgagatacc caacaatctc ctagtttatc ttctttaaca
21361 ttatcttcca tcattaacat ttcagttatt tgttgttcag gattcatatt aagttcaata
21421 agggcatcat gtaatcccat gaaataagcc atttcttttt ctgtctgatt acctggtctg
21481 cttcctaaat cttctgatac tggtgaaatt ataaatacta gctttctatt tttattaaga
21541 tagtctgcgt aagcacaggc tactgagcac attgttttac ctgtaccggc ttgactctca
21601 ttccaaagta tttcaacatt atcattaaag aaatcctcac agaaatctaa ctgctcggtt
21661 gtagcttttt caaggaattc attaaagact agatgttctc ccatgttgta tcttacatta
21721 ggataatctt ttaacttaaa gtctaactct tttagttgta ttgccatatt ttaaagttcc
21781 cctatctata aatagtttta ctctcttta atatagtact aatttccgat atattctcct
21841 gttgaagagc aataattact acattcacat tcagggtagt tatcacaaac atcttcatct
21901 tctacatcat cataaccaat atcataatta ttataattaa aatctacaat acaattttca
21961 ctattacctt tagataatcc tgtataaata atatcatcca cagaatccca atcgttatct
22021 gccaagtaat ttacactatc tagtactgat tcattatcag gtaaataaat actaccgtct
22081 gaaaatttaa ttaaaatatc accttgaggt aaggtatcat taattaaatc aatctctgtt
22141 tcttcttcaa tagtgaatac agttccttct aatctttccg gtgtagtatg tgttaaatgt
22201 tttacagtat cccctgattc ttcatagaat cctactgcat tcatatcttt attatatttt
22261 gcaataaatt taccattgtc acttaccaaa tattgactag ttgcattata gtcgtttgcg
22321 tcatctactg tcatgcaagg gttataatct ttaacataat aactaatttt cctaacatct
22381 gctgtttgta ctttcttacc ttcacccttta attactgaat taattttctt cataatattt
22441 tctccttttt atatatcaat tgatttttt gcaagattat cggcatagtc attccatttg
22501 tcatttgaat ggctcttac ttttacaaag tttatatcta ttactttttg gtattctcgt
22561 atcatattaa tatatgtttt acttagaata ttcttgcag accaagtacc ttcataccaa
22621 tgtattaaac caataatc tatataaact attgcctgat tgtatcctga ttttatagcc
22681 tcttcaatac cataacaaca agccaatatt tcacctgcaa cattattata ctttattaat
22741 cctggtttgt caacactttt actaattcc gatattatat ttccttctt acttaccaag
22801 acagcacctg agcctacttt acctttatta tatgaggagc taccgtctgt gtatatattt
22861 acactatcct gcatactat aatcctccat aaattgaggg aattcacaat ctgaatagac
22921 ttctctgcaa aaagatactg agatatagtt aaaatcaaaa cattgaaac agtgttcttg
22981 aacttctttt ttatcttag caatcacatt aaatttaaaa ccatcagcta ttactgtaaa
23041 tactccttt ttcataaaac aaatacctcc actaatttta tttaaaatta ataactaact
23101 caataaatga tttaaatagtt ttattttac cttcatcaat atctgaaaag aaattaatta
23161 aactgtcatc ctcatcaaat aaatcttcaa catcatcaaa tttatttaat atgtctgtaa
23221 cactgtaacc ctcttctgat atatactcat gtaagtcttc tccatcttct gacagtgttg
```

Figure 18 (contd.)

23281 cttctatttt accatttta ctttcaatta aatataaagt atttaacact ttaacagaat
23341 ctacaactac actgtagtta ctaatagtag gatactctgt ataaagtatt tctacattag
23401 tattcatata actatcaatt acagagttaa ctgtatctct ttttagctca gatacattat
23461 gttttcgtat agtaggaaat tcttcatcat attctactaa ttcttttcta tctgtattca
23521 ataacttgtc taaagaggac aacaatacta ttttatattg gttatcagga agactgtctg
23581 taatttccat tattgttaaa aacgtatctt cacctagaac tttgttata tcttgtaatt
23641 caaatgaatc taccatttca atagtatcat ctatatcatc tgtagtcatt aaaaaattaa

Figure 18 (contd.)

23701 ctaaattatt attctccatc gtcttcctcc aattctttaa ataactcttt tcctggagta
23761 tttaacgctt tctctaaccg cattaaatta gcacttcttg gtttcttttt tccatactcc
23821 caataagata taagagagta atgaacacct atctcagaag ctagacttct taacgtatgt
23881 ccttttcta ctctaatttt ttgaaggttt agaggtttac tttccttttt ttcatccata
23941 attatttctc ctctactttt aaaaatttaa aatcctcaga tgcttttgca ttttttagta
24001 tatactcttg tgatttattt cttgcctctg ccttactttt agcatataac tctatatgaa
24061 atacatgagg tttttttaaa gacggtgact cgtatctcca ataaactta aaaagtagtg
24121 tttcttttt taaaacatta attcgaaacc atctttaaa tttattcatt cattatcctc
24181 ctctatttat ttgttaaact aattatagca tagttaactt atgaagtcaa ctataatata
24241 caaaaaaga ctaagaaatt aatcttagtc ttaatatatt aataactatt atgtgcgttg
24301 tggtatgcaa gagctcctga tgttgaaccg taacggtcaa tcatatattg ttttgcacct
24361 ttagtttgtt ctgctataga accaccactc catgatttac ctaatccttg gaataatcct
24421 tgagctcctg atgatgcatt aacagcatta gggttcattg tagattcacg catagcaatt
24481 tcaatcattg cctcgtctcc acctgcttgt ctaatctgtt ctgctacaga gcctcctgta
24541 gaactagttg attgtgtagg ttgtttagtt tccttttgaa ctggtgctga tgttgttgt
24601 acttcttttt tagtatcttg tttattttga gtatcaaatt gtgcttgttg ttggtctact
24661 ttttgttcag gtgtttgttc ttctcctgct aatctagata ctgtattatc tacttgagtt
24721 gagcctgaat ggtattcata accaaagtta ccattataat tatagaaatg ataagtaaat
24781 tcaccatcac taaaagagaa atcataatta cctgctgaa ttggttttgt atttacttct
24841 gctgaatttg atttagcttg ttctgctaac ttattataat caattcgtc tgcactagct
24901 tcattgtag caataccctcc aaaagtaata gctgtaccta atgctaatgt tgcaaaaatt
24961 gttttcttca taaatttaaa actccttaaa taatttttta gaattgttta tttgtaaacc
25021 gacataagta atcataacat atatctttaa ataacgcaag tataatatag cactaattag
25081 tgtaatatta ttaaggtttt attacaaaca ttacagtat cagataatta aatacaaaaa
25141 aagagaggta attatattta ccactctcca gtttcattat atttatttat tacattatct
25201 cttaattcta tagcctcttc taaagatttt gcactaaaat atttaactt attttttctt
25261 acaatttgta tattatatac attatttgat ttttttgtata tattatgtgt acttttcttt
25321 cttatattag ttgagttttc agacctagta gaccacttaa cattaccagg ttcataatta
25381 ccatcattat ttattctatc tatttgataa ttttcattcg gagggtctcc catatagtcg
25441 tagaattttt taaaatcatt cttccattct tcacatattt ctataccct tcctccatag
25501 tttttataat ttatagcgtt aacatcgtaa caacgctgtt tcatacctaa ccatctttgg
25561 tacattgggt tactggataa tccatgggta gtattccttt ctctcattaa ctcactatga
25621 attttattac tctcacaccc acaagattt attttacctt gccttaaagt ggagcttcta
25681 actattatta cttctccgca ttcacataaa cattcataca tttacatct tgatttatcc
25741 ctcttactag actcttttat aactttttagt ttattaatag tttctccaat cataatatct
25801 cctcctataa taaaactata gcataaaaaa ccacctatgt caataggtgg ttaaacatat
25861 tatttattta agtttgtaat aacactatct gaacctatac taataggttg ttttccattc
25921 cattttcaa ttaattgttg ttgtaaaact tcctctgtta aggattcact tctaatgtca
25981 ttggcttct tttcacctttt tgcttcaatt tctttctttt tagcgttttc ttctgctatt
26041 tgcttatcaa ctttagtgcg ctctagttct tggtttgctt ttactctctc atcaattgct
26101 ttttgagtat tttatctgc agttgggctt gataatgcaa tatcatcaat aataaaacct
26161 tgctttttcta aattatcatt aagtttattt aaagtatctt gtttaatttc tcctgttttt
26221 acaccaaaag catcaattac agagtactta gaaattgctt gtctaacatt atcttgtact
26281 ctagaacgaa gatacccttt ttcaagttct tctatgtcag cacttccgaa tctattaaaa
26341 aggttactg ccttagttgc atctacttta taagatacat caatgtctaa tttaatattt
26401 ttaccatctg aagttgctac atttaaatct ttatatttat gtgtttgtgt tttagttggg
26461 tatttattta ccttatcaaa aggtgctgtt aaatgccaac ccggtgattt agtatcttcc
26521 ttaacaccat ttactgagta tacaactcca acatgaccct gtggaatctt agtaatacac
26581 attaataaaa taataaaccc tataattgct aaaaacccta atactcctga aataactact

Figure 18 (contd.)

```
26641 gactttctca ttacatttct cctttttcta tttcttttat taagctattt aaagcttttt
26701 cctcttggtc tatttcttgt ttatcggctc tagttacaat tgattgtcta cggtcattta
26761 agaattgttt tttatatctt acatattgtt ctaaaccgta ttcatctaat gtaccttgcc
26821 taactaattc cctgtattgt tttcttatgt tactcttctt ctctttcatt gaaagaaaat
26881 caaataaata acttatacca aaacctacaa ggactagaaa aacaataaaa atagcaaaat
26941 atgttaaaag tagtgccatg taattcctcc tttatttgat tacatatata actatacact
27001 atgtatttaa ttttgtcaac acttttttgc aaaaaaaata gacggatttt aaatccgtct
27061 aaatttatat tctatttgaa tactccccag gcaacgccag gtatttgatt aggtggaaca
27121 ccttgacaag ttctaacagg gcaatatact ctgttaccgt tgtaagcatt ataacctatc
27181 caaatgtgac ctgcttggat acaaacttcg tcatatacaa ttgtagcccc tgccggtaag
27241 ttaccgccta ctggagcatt taagaatgga gaacctattc tagttactat aggttggtta
27301 ccattgacaa atgttgcatt ttccggttta taccaagttc cgtactggtc cttttttccaa
27361 gaacctgtaa ctggtctagt tgccggtgta cttgcgctac ttgtttacc atctttaact
27421 actgtagaac ttgaagttcc tttatccatg tagttttttaa tttgtttaat gaaataatct
27481 tttaatttat tcattattgc ttgtgatggt cttccttgtg ttactggatt aaatcctgta
27541 tgaagaacca tagaacggtg aggacaggca gttggtacaa attccatatg caatcttaca
27601 gttttacggt taggagtaag accccattct ttaaatttct ctgctgtaaa ttggaatact
27661 gcttgttcat ttttaaggaa ttgagcatca ctagcactca ttgattgaca gacttcaata
27721 cctgcaaatc taaagttacc tgagtttgct cctgttccat ccgattattc aataaaagac
27781 gtaactcctt taccggttct cttatgaact cctatagtt tcctataaga ctagactata
27841 tcttcaccct aatttttgtta ggggttctcc atttcgattt aagggattct cacccactcc
27901 attaacttga gccctactcc tattgacgat ttatttttat tggcactcgt ccgagggata
27961 gtcgttgaac cttaatattg tttccaaatg tatccgtagg ctgttttct ctctccttg
28021 atacatcttc ctatattacc acttcttta ttagaaatac ctaagaactc taaagcctct
28081 tgagctgtgt aaaagacatt caataaatta ccttctaagt catactgagc tatattataa
28141 tttattctat ttttttaatcc tgtctttatt gcatgttctc tgttctcgga attagaaacc
28201 cattctaaat ttcctacact attatcattt ttaccatta aatggttaac ttgttcttta
28261 ttatcaggat taggtataaa agccatagca actaaacgat gtattttagg tgaatggtat
28321 cgtaaccta caaacaagta acccttgtta ttttttgaa gttttaactt tttaggctct
28381 ttacctttat aagatattac ttctccttta tcagtaatag tgtaattttc atatatttct
28441 aatccaggta tttcatttaa tttctttttcc ataataacat ctcctttact taagtatata
28501 ggaaagttat tatgttgtca agtagttttt taaaacaata ttcttggatg ctgattagca
28561 tagctgata gccttagcct cccagtcaat taaaagaact ttcattatac attactgtat
28621 aacagggcaa tttatttacc cgtgtgccaa gcaatttgat tcttagcatc tattgcttcc
28681 catacataac cttcagagcc gtagtaatga gcaataccat tagcgtatct agcataacct
28741 gcattagcta atgaattctc gtatgttgt cctgaagaac gacctgcatc gttgtgtatt
28801 accattcctt caggttttt accacgttta tccattgtat agttaatgtg attcttagaa
28861 acttttagtg ttgctttctt tttaggtgca ggcgtttac ttgcgctttt cttagctgtt
28921 tcttttttaa cagtagtcc tgctttaca ggtatttcaa tgaagtgagt taatccgtaa
28981 taattatcta cacgttttgt aggttttta ttagcataac cattccagtt ttgctctaaa
29041 atagtaaatg tagaagtatt acctccatca tatacaatac ctatgtgacc ccactgttca
29101 taactaccgg atgtaaatac cgcaatccaa ccttttttag gtacagtaga aggtttattt
29161 tcatgtattt taaatccagt accataactc tgtttaattt ggtctttagc attaccccaa
29221 gttctaactt tattatctgt taaccataaa acatagtctg taataaggtc ttgacactga
29281 gcgtgatagt aaccatctgc atcaatggct cctgcttcca ttacaccaaa tgatgggtca
29341 taacttgtag ctttttaac tctgtaaggg ctatctactg ttccttttgc ataagcatct
29401 aaacgtttat ttattctgc ttgagtctta gccattactt aacttcctcc tctgcaaata
29461 ctttaccatg ttcctcggta tcttcttcat cttgagaagg tgctgaacca ccatcaattt
29521 catcttcaat agcaggtact tcatcactat catctgtgtc aggttctgca ttgttttcgt
29581 agctgtctat ctcaaaagta ctagtgttat ttgcatttgc ttgccattga acgaattcat
29641 tagggtcttt actatcacga ggtttaagat agtctgtttg aacaatatca ctatctttaa
29701 gacctttagt attattatca acaataatac ctaaacctgc taatagtgtt agtatagaac
29761 ctacaatatt tacacccttgc tcaatttgag ctgagtagtc taaaccgaaa gcacctataa
29821 ttggttagc aataatgct actgctgata taattgctac ccaaaatgtt ttgctcttag
29881 ttcttgtgct aaggtttatt cctccaacaa cttaggttg tttagtttca ttagccatta
29941 aaaaccgac ctttctatta tatttatttc taacaataat ataacagtag gtcggtcatg
```

Figure 18 (contd.)

```
30001 tttatctata ttaatttaac acttactcat taatttggtt tagtttttg ataacttcag
30061 acatttgttt gttatctaaa tcttctaatt tagtttcagg aagtagctct aacttatccc
30121 aaacttcttc tttattagat actttattat taataattgc cttaccaact aaactttccg
30181 tataatataa ttgttttgct gatgccattt gtatctctcc tttaaatat gtaaagtata
30241 tagctagtat cgtatcctag gaacaaacac ttgcgctata tactcaatga aatcctaccc
30301 tcattcgagg acacagcaaa ccggttcgtc aaccgcacat atgaattctc agatttcatt
30361 tatgtaaaac acaccctctt tgattgcac aaagactaag ggttttggag acccttgtac
30421 tactaattat actaagggtg tttattatgg tttctattgg atttgaacca atgacaccta
30481 gagcttcaat ctagtgctct accatctgag ctaagaaacc ttaaaacgac ccatacgaga
30541 ctcgaactcg tactctctgc cgtgacaggg cagtgtgtta accagttaca ccaatgagcc
30601 aaaattataa tgctataccc taaccttacc ttaatgtata gcaggttttt ataaagctc
30661 gaagcaacga ttattaccac tcataacaac tatatattaa gtgaaaggag gtgaaatgaa
30721 caaaacgtgg taattggtac ttatatagga aatatgtata atctacaagg agtaagttat
30781 tggttcataa aggagtgtga acaataaata catgaaagag tgaaagttta ctccctgtag
30841 attcttttt taattatcaa tcaaaggagg aaactgataa ttgttaataa taaactataa
30901 agaggaaaat atttatagtc acattctgat ataatgcaac taaatatcca agcataaccc
30961 gtctcacgag gaacctacct ataagacctg ttattaagtg aatcactacg attgactcta
31021 ttaaggagct accttaagtc catctcacgc aatttaaaag ggacttacaa accgtaaaac
31081 ggtaataagt ttattaaata atgtgatatt aacatatttag ttaataactt tcacatggtc
31141 gaagaaaagt aaatttattt gattaccaaa ttatttttat caaatatagc tcttttgaac
31201 ctgtagattt atgctactta tactgataac ctctattatc taacacattt ctgtgctcca
31261 actacagtta gtcgttacag cgtatctttc taggattccg ctaagaccct aaaaagaaat
31321 taaaccctag ccgttatcat actctacaga ccttataagt aagtaccaag tataccaatc
31381 gtatttaaca atactaatga cgacccatcc taccgatata tctccgatag gttttgattc
31441 gtttgattat cttgtaccttt atgactacca aatcattatt cagtcactat gctcagatat
31501 ttagttgtat tatttatata ttaattataa cataattttt attacttgtc aagttaattt
31561 caaaaaaatt atagaagtag ggacgtttac ctacttctat ttaatttaca caaggatgat
31621 aacattgtta ttgttttata ctggaaaaca atgtaataaa aacagtgatg tgtaaggtat
31681 ttgttttatt gttaattata ttatagcata tactgatacc tttgtcaagt taatttaata
31741 cttttttta aacattagtt atcttttgtt agttcctcct gaatagcatc ccatcttctt
31801 tctgcttcac tacgattatc ttctatatgt tttgtagttt tacaacattt gatacaatat
31861 atatctttga tatgaccttc ttctcttttta tttgctcttt ttcttggtac tttgaataca
31921 tttccacatt ctttacatat taaacttgag taaaacattt tttgtctttt cataattaat
31981 caattccttt tctctttat ttgataattt aactatatac tatattgata aataagtcaa
32041 cagttttcta aaaataattt aaattatttt gaagaatact ttaatatcaa gggttacaag
32101 agaaaaagta cgtatttaga aaataaggag tactcctatt atatataatt atattctgat
32161 atagagtaat aaataatatt aaatatataa ttataattaa taaggttggg aaaattgata
32221 taaacataac tgatactgct tatagatact cagtataaaa gtaaatccc ttagtatcag
32281 tacttacagg caaaaagta cgtatttaga aaataaggag ctctcctatt atagttatat
32341 atatttatta ctattattaa ttactatta aatatataat tataattaac aatgttagaa
32401 agtcaacaat agtataaata aaaagtgac tacttaaagt cactcaataa ttagaatact
32461 atttaaaag attctattct gtttggatta atatatactt gaggtgaagt tatagcactt
32521 tcagtatata cttttataga ggtttcatcc attcctctta acatataatc tatatcttgc
32581 ctattgtaac tcttttcatc agtagatact aaaaagtatt tagctccact tgacattgtt
32641 atttcaatat gttttgacat ctacaatctc tcctatgcaa atttgttaaa gacaaaggat
32701 aatatagctc ctagaacaag taaaagaacc ttctcagttg tatcctttt cttagtatcc
32761 ttagtttttg tactttcagc aagttctgaa atcttttcat caagtctttc taattggacg
32821 taaattgctg attgttttc actattgaca gctacatctt tatctatact aactatcatt
32881 tttcttagtt cagctaccctc aacttctaaa tcttttgaaag ttcctctatc tatataatta
32941 ccttcttgta tcttagactt aatagtttct acttgagaaa caaggttgtt tatctcctta
33001 tccaactaga atcacctcta aggtctaacc gtttcagatt cagaatggat atcataattt
33061 tctaagaaat cattgataat ctccatataa ttatccgtaa cgacttttcc gtaagatgtt
33121 tttgtatcaa tttcaaacct aagcttacca aaactttgga ggtctaattc tttttattaca
33181 atattagggt catcagaagg aaggtaataa tagtcgaagt atataattga gccatttatt
33241 aatactctgt ctattctata gacgtggaaa tagcgtctgt ctctttaaa atgggctagt
33301 gcatctttaa actctaactt aaggatatcc ttatatttag tcaaagtggt aacctcctta
```

Figure 18 (contd.)

```
33361 ctattaattt ttaaatttac ttattttgtg gtataatagt tatgataaag gcagttatta
33421 taattatatt aagaataatg ataataatta tttttctga gaaaataagc caaatactaa
33481 aaacagataa agcatagata gctgatagat atactatatt aagagttacc ttactttat
33541 cttttctata gatagaataa cctaaagacg ttgtaacacc actaagtata aaataataga
33601 aacaaaaaag aggtatagac agaaaaaaag atacgataat cattgttaaa cacctatttc
33661 ttttgacct attatttcta gaactttag attacaccac taatataaca ttaaaagcca
33721 gtcataaaag tcaattgtta gattaataat ataataaaaa aagacaatag gaggttaaag
33781 tggttgaata ataacatagc tatattcata ttcaaaacac tggttatcat tatattctta
33841 ctactaattt tgtctgttat taattcctg tcccttattt actcaataag accgagtgta
33901 gttatgacat actttatctt tggtggtatt gtttctaatg tcgcacttac tgtaacagat
33961 aagttcttac tgaagaaaga agacccccta cctgaatatg ttcttaaaaa agtagagata
34021 aatgataaag aaataagaat aatcaagaaa ataatagaaa gtaattatgg tataacagca
34081 gaagagataa aagttagggc taaagcacaa agaagagtag aggaagatag taaaaaggaa
34141 gattacaatg aaaacaaaga aagaaattaa agaacaaagg aaagaactta aggatggtgc
34201 tacatctgtt tctttagtaa aaaagggaga taagagaata gctagcccta gtagaatttg
34261 tagtctatgt ggtcagcagt tatcaggtat gaattacact aaaggaaaag cattatcaaa
34321 agttaatcat tttcatttac agtattctaa gtatatttat tttgatattt gcgcagatat
34381 caacaattgt tataaaaatt taagaaaacg aggtgaaatg gattgagtgc agaaaatatt
34441 agagatataa ttaacaagaa aaagttagaa gaagaggata caagaaaata tatagctgat
34501 gggtttatga atggtatcgg taaattaatg tacgaattta ataagaaagt agataacaaa
34561 gaaatagaag ttaaagaccc gaatgattta tacaaattat ttgtgatatt ctctcaaatg
34621 caaaatatgg tcaatgaaac ttctgaagga ggagcaatac ctcaactatc tagacctcaa
34681 caggaattat ttgatgagat tacaacagaa gatagtaatg gagaatctac agttgattta
34741 cagaagatat cagaaatgtc agcggaagat attacagcaa tgatttctga aaaggaaaaa
34801 gtaatgaatg aggaaaattc agaaacattc taaggagaaa gatataaatg gatggaaaag
34861 aactaattaa gatagcacaa gaaacatttc aaactgaaaa aataacaaga gaacagatag
34921 accatataat caatatgcta aatccttcta cctatatgct taagtatcat acactgagag
34981 ggcatcctat aactttagt attcctaata gagatagaag taaagcacag gctcatagac
35041 cttggcaaac taggattgta aatgatactc atcctaataa ggctgtaata aaatcacgtc
35101 agttaggtct tagtgaaatg ggtgtaatgg aaatggttca ttttgcagat atgcatagtt
35161 atgctaatgc aaagtgtctg tatacattcc ctacaaacga acaaatgaaa aaatttgttc
35221 agtcacgttt gaaccctgtt ttagagaaag aatatttag agacattgtt gattgggata
35281 aagactcgtt aggttttaaa aagataagaa actctagttt attcttaga acaagttcta
35341 aagcaagtac tgtagagggt gtggatattg actatttatc tttagatgag tatgacaggg
35401 taaacttatt agcagaatcg tctgcattag aatcaatgtc ttcatcacct tttaagattg
35461 tgagaagatg gagcacacct tctgtacctg ggatgggtat acacaaatta taccaacaat
35521 cagaccagtg gtattacggt catagatgtc aacattgtga ttacttaaat gaaatgagtt
35581 ataatgatta caaccctgat aatcttgaag aaagtggaaa tatgttatgt gttaatcctg
35641 aaggtgtaga tgagcaagct aaaaacagtac agaatggcag ttaccaattt gtttgtcaaa
35701 aatgtggtaa accactagat agatggtata atggtgagtg gcattgtaag taccctgagc
35761 gtacaaaagg taataaaggg gtacgaggat acctaataac acaaatgaac gctgtatgga
35821 ttctgctga tgaattaaaa gagaaagaaa tgaatacaga atctaagcaa gcattctaca
35881 actatatttt aggttatcct tttgaagatg ttaaacttag agttaatgaa gaagatgttt
35941 atggtaacaa atcacctatt gcagaaacac aattaatgaa acgagataga tattctcata
36001 tagctattgg tatagattgg ggaaatactc actggataac tgttcatggt atgttaccta
36061 atggtaaggt agacttaata cgattattct ctgttaaaaa aatgacaaga cctgatttag
36121 ttgaagcaga tttagaaaaa ataatttggg aaaatatctaa gtacgaccct gatattataa
36181 ttgcagataa cgggggactca ggtaataatg ttttaaaact cattaatcat tttggaaaag
36241 ataaagtatt tggatgtact tataaatctt ctcctaaatc taccggacaa ttaagacctg
36301 aatttaatga gaacaataat aggggttacag tggataaatt aatgcagaat aaaagatatg
36361 tacaagcact taagacaaag gatataagtg tttatagtac agtagatgat gatttaaaaa
36421 cttttcttaaa acattggcag aatgttgtta ttatggatga agaagatgaa aaaactggag
36481 aaatgtacca agttatcaaa cgtaaaggtg acgaccacta tgcacaagca agtgtctacg
36541 cctatatagg attaacaaga ataaaagaac ttcttaaaga aggaaacggt acaagcttg
36601 gttctacatt tgtttctact gattacaatc aagaaggaaa taacaattc tactttgatg
36661 aatagaggtg aaatagactt gacagataaa ttattttatg gtacaattag taatgaagaa
```

Figure 18 (contd.)

```
36721 attaataaaa gtgtattgaa tttgttattg ggtgaggaat tatccttaga ttatgtttct
36781 aaaaatagtg atactttaga tgttaaatat gaacatgttt ataaatctct aggattcgat
36841 aatttctttg attgttttt atatgctaat agagagcctg aaatagtcca taaggtgga
36901 gataaaaatc ttggtggact aaataaggtt aaacgtactg ttattcgtaa tggtaaagaa
36961 atggaaatga cagtttacga agatggtaat aaagagaacg atagtaaaga aaaacaagaa
37021 ggaaaagaag aagttagtag aagtgcagta ggagcaaggg ctatttctaa tggtgaagaa
37081 ggaaaggtaa accctaaaaa ggtagcaaat tcattatcta atttaagtaa aaaaggtgta
37141 gatgtatcac atattaatac aaactcatca ttgtataaag agtttgttga tgataacggt
37201 gatacattag gaattacatc ttttaaacga actgaaaatg atataatatt agaatcttat
37261 gcaagttcac atgattcaga tggtgtagga gcaagagcta ttatggaatt attacgttta
37321 agtattaagg aaaataaaaa tgcagttgtg tatgatatag aattacctga agcagtagag
37381 tatttaaaaa ctttaggatt taaacctaat aaagatggat acatcttaag aaaaaaagat
37441 gtaaaacaat tcttaggtga ttatagtgat tttatttagc actatagtca tctattctat
37501 tgtatttatt ctatatattg tattaaaaac aatttatata aagtctaata tgagtagaat
37561 agataacaca actgaattat taaaaatatt acaggaagat attgaaggta agataaaaaa
37621 ggaaggaaga aataaatgac tttagaagaa aataaattaa cattagaaga atcaataact
37681 ccacttagca aagaggagaa agaagatagt attaaagaat ttagcagttt attatgtgaa
37741 atggtaaata gactatataa gtcttataat gtatttagac aagacccctat ggatgaaact
37801 caacgtctag atggctcttt aatggtcttt caaagtagat taaatgaccc tttaacagga
37861 gatttacatg ataagatgta taaacttgct ttttcaaaac gtattgatat ttcgaagct
37921 aataagcaat ttagaaaaga tgtagaagca ggtaaagcaa ttgagttagg tgatgtagct
37981 attatagata cagcattaag taacatcctt tcaggcaatg agttccaagg aagtatttca
38041 tttatgctta gaaaagactt tgaagaaaaa gaacgaatta gaaaagaaga agaagagaaa
38101 cttaataact tataaaaggg aagaattatg agactatata aatgaggta tcataattga
38161 aaaagaaacc acaaggcaat gaggtaatca taaccataat aacggttatg atgcagtat
38221 tgtagtcat tatgaccata ttttttaata aatatcaaga tgctaaagaa gataaagata
38281 gatatcaaag attagtagag atttataaaa aagcagatga taatgatggt gagactaaaa
38341 agaaatatgt taaagatta aataaggctg aagaagaact taaaaagta aaaaaagaaa
38401 caaattataa agattataaa aagaagtcaa gtaaagaaag acaaaaagaa gataaagaaa
38461 ctagagagaa aatatatgat gtaactggtg atgatgactt aatattagta aaaataata
38521 ttgagtttag tgataaagta gacaagcccg aaatacttat tagtgaagat ggaattggta
38581 cgataactgt tcctgtagat agtgggtatg aaaaacaaac agtaggttct attattacta
38641 gtgtattagg ttctccttc ctatcacctg gttcaaatag tatagatggt ttaagtgtta
38701 ttaacgataa tgtttatcca aatacagtag atagcatagt agaagataca aaaccttcta
38761 ttaacttacc aacggataat cctattataa caaatccagt tgaaccaact atacctcag
38821 atattatacc tcctattgat aatccttcag ttccgatatc tcctgagaac ccaggagata
38881 ataatcaagg aaatacagat aatccaaatc ctccccctcc aggtacaca gatgaagatg
38941 gtggaagagg ctccggtggt ggaggaaatt ctgaaccacc atcaacggaa gaaccttcgg
39001 ataatggtaa caccggagga ggagattggg aagaaaaacc tgacccagga gaagaacctt
39061 cagataatgg taatacagga ggaaatggtg gagaagttac gcctgaacct gaacctgaac
39121 ctgaacctga acctgaacct gaacctgaac ctgaaccatc tgaaccgtct gacaatcctg
39181 atgaaaatgg aggatgggaa actgaaccaa ctgaacctga gtcaccttca gagccggacg
39241 ataaagtgga cgaagaagat aaaaatgaag atactacaga tgataaacag cccactgaac
39301 aaccggacga taacaacata gataatgaag ataaaactga agaggagtaa ttactcctct
39361 ttttgttg ctatattaaa taagagctaa atataaaaaa attgaacatt acggtggtga
39421 aaactttgtt aggaatgaat attataacgt cactatcagt agtatttact tgtttaagtc
39481 ttttaacttt aatgattttt gttcatagta agttctctag taaaaacgtt ttgttttgt
39541 atgtaattta tgctataata ggaataggta catacatagt tttaactatg tttcaaacaa
39601 catctgtact tattaagaat gatgtaatag attccataga aaatactgaa cattatattg
39661 gattcaatga ccctataatt atatttacta taagtttat aggtgcaata cttggaggaa
39721 tttggtacaa gatgatgaaa attattaaaa agagtaactt taagataaaa aaataaaaa
39781 gacggtgaat aggttgatat tctctaaaga taaaaatgg gatgaagcaa aagatttcat
39841 caaaggtcaa ggtatgcaag ataattggat agagattgta gattattata gacagatagg
39901 tggaaaacac gtagctgttt ttattgcttt aaacaaagta aaatacatga ttctagaagc
39961 aacaaaagac aataaggtaa tattagtaga taaagataat atatactat tagaagatta
40021 tgatattgtt atggaaagta agaagatgtt ttattacatt gaagaaccgt tcgaggttaa
```

```
40081 aataaatatc cctcaacata ttagagatgt aacttataat aatactgttg tattaactac
40141 agtaagaggg agtagaggtg actagtaatt ggcagatta tttaagcaat tcagattagg
40201 taaagactat ggtaataata gtaccattgc tcaagttcct attgatgaag gattacaagc
40261 taacattaaa aaaatagaac aagacaataa agagtatcaa gatttaacta agtctttata
40321 cggacagcaa caggcttatg cagagccatt tatagaaatg atggatacga atcctgaatt
40381 tagagataag agaagttaca tgaagaacga acataactta catgatgttt tgaaaaagtt
40441 tggtaataac cctatcctta atgctatcat acttacacgt tcaaatcaag tagctatgta
40501 ttgtcaacct gcaagatatt cagagaaagg tttaggtttt gaggtaagat taagagacct
40561 agatgcggaa cccggtagaa aagaaaaaga agaaatgaaa cgtatagaag attttattgt
40621 taatacaggt aaagataaag atgtagatag agattcattt caaactttct gtaagaaaat
40681 tgttagagat acttacatct atgaccaagt taactttgaa aaagtatttta ataagaataa
40741 taaaactaaa ttagaaaaat tcatagcagt agaccctct actatttttt atgcaacaga
40801 taaaaaggt aaaattatta agggtggtaa gagatttgtt caagtagtag ataaaagagt
40861 agtagctagt tttacttcta gagagttagc tatgggtata agaaacccta gaactgaatt
40921 atcttcttca ggatatggat tatcagaagt agagatagct atgaaagagt ttattgccta
40981 caataacact gaatcattta atgatagatt cttctcccac ggtggtacta ctagaggtat
41041 tttacagata cgttcgacc aacaacaatc acaacatgca ttagagaact ttaagcgtga
41101 atggaaatct agtttatcag gtatcaacgg ttcatggcaa ataccagtgg taatggcaga
41161 tgatattaaa tttgtcaata tgacaccaac tgctaatgat atgcaatttg agaaatggtt
41221 aaattacctt atcaatatta tatctgcttt atatggtatt gaccctgcag aaattggttt
41281 ccctaataga ggaggagcta caggttctaa aggtggttct actttaaatg aggctgaccc
41341 gggtaaaaaa caacaacaat ctcaaaataa aggtttacaa cctttactta gatttattga
41401 agacttagtt aatagacata ttatatcaga atatggagat aagtatacat tccaattcgt
41461 aggtggagat actaagagtg ctactgataa acttaatatt cttaaactag agactcaaat
41521 atttaaaaca gttaatgagg ctagagaaga gcaaggtaag aaacctattg aaggtggaga
41581 cattattcta gatgcttcat tcttacaagg aacagcccaa ttacaacaag ataaacaata
41641 taatgatggt aaacaaaaag aacgtttaca aatgatgatg agtttactag aaggagacaa
41701 tgatgattct gaagaagggc aatcaacaga ttctagtaat gatgataaag agataggaac
41761 agatgcacaa ataaaaggtg acgataatgt ttatcgtact caaacatcta ataaaggtca
41821 aggaagaaaa ggagaaaaat cttctgactt taaacattaa ttaataagcc tagaataaat
41881 ctaggctttg ttttattttt tcgtaattta atttttgataa atgtaataac tatgatatac
41941 tatatgtaat tgatattaat acataaaaaa tattaatatt tcacttacaa gttattattg
42001 ttatattatt aacgtaaaag taaataaaat aacaagtgga ggtgtagaca cctttggaag
42061 aaataaaatt taatgctttt gtacctatgg atttgaagaa atctgtatca acagcttctg
42121 atactaatga gtattctatc gtttcaggat gggctagtac tccaagtatg gatttacaga
42181 atgatatagt taatcctaaa ggaatagata tagagtattt taagtcacaa gggtacatta
42241 attatgagca tcaaagtgat aaagttgtag gtatacctac agagaattgc tatgtggata
42301 tagaaaaagg tttatttatt gaagcaaagc tatggaagaa tgacgaaaat gttgttaaga
42361 tgcttgattt agctgagaaa ttagaaaaat caggtagtgg aagacgttta ggttttctta
42421 ttgaaggtgc agttaaaaaa cgtaatataa atgacaatcg agttattgat gaagttatga
42481 taaccggagt tgcattagtt aaaaaccctg ctaatcctga agcaacatgg gaaagcttta
42541 tgaaatcatt tttaactggt catggtacat cacctgacac tcaagttgat gcaggagctt
42601 taagaaaaga agaaatagca tctagcatta caaatttagc ttacgtcact aagattaaag
42661 atttaaaaga gtttaatgat gtatggaatg gcgttgttga agatttgagt aaatctaata
42721 gtatgggata tgaggaatca gtccttacgt tacaactagc taaaggttta tctcgtaaag
42781 atgcagaact agcagtaatg gatataaaca aacaaaaact agaataggta aggagaatac
42841 attctatgag taaagaaatg caaaatattt tagaagagta tgataagtta aatgctcaag
42901 aggcagtttc gaaatctgta gaagatgatg aaaagaatac agtagaatct accgaagagc
42961 aagtagcaga aacaactgaa gaacctgcta agaacctga aaagtatct gaggaagatg
43021 ctaaagaagc acaagagcaa ggtgaaaaag ttgaatctga agaggtagca gaaggcaatg
43081 aagatgagga agttgaaaaa tcagctaaag aatcaaaaga ccctgtagac caaaagata
43141 ctaagacaga aaataaagac aacgagaaac gtaaaaataa aaaagataaa aagaagatt
43201 ctgacgatga agataaagat actgacgatg ataagataa gaaagaagat aagaaggaaa
43261 aaactctaa atcaatttct gatgaagata tcacaacagt attaaatct atcttaacat
43321 cttttgaaaa cttaaataaa gagaaagaaa actttgctac taaagaagat ttaagtgaag
43381 ttagtaaatc tattaatgag ttatcagcaa aaattctga aatccaagct gaagatgttt
```

Figure 18 (contd.)

```
43441 ctaaatcagt agacactgat gaagaagctg tagaaaaatc agtaacatct acaaacggag
43501 agcaagaaaa agtagaaggt tacgtttcta aatcagtaga cactgaagaa caagctgaaa
43561 ctggtgaagc aaaatcagaa gaagctgaag aagtacaaga agataacaca tttaaaggat
43621 taagtcaaga agaacgaact aagttcatgg attcttacaa agcacaagct aaagaccta
43681 gagcttctaa acatgactta caatcagctt accaatctta cttgaacatt aacactgacc
43741 ctactaatgc atcagagaaa gatattaaaa ctgtaaaaga ctttgcacaa atttaattaa
43801 tgcacaaagt tgtgttatat tatacggtgt aactaaagaa tataaatagg gtacatttta
43861 ctgtacccta cataaaataa aaagaacaca aatgaaaggt gataaattta tatgactatc
43921 gaaaagaacc tgtcagacgt tcaacaaaag tacgctgacc aattccaaga agacgtagta    Figure 18 (contd.)
43981 aagtcattcc aaactggtta tggaatcact cctgatacac aaattgacgc aggagcttta
44041 cgtagagaaa ttttagatga ccaaatcaca atgttaacat ggactaatga agacttaatc
44101 ttctatcgtg atatctcacg ccgtcctgct caatctacag tagtaaaata cgaccaatat
44161 ttacgtcatg gtaacgtagg tcactctcgt ttcgttaaag aaatcggagt agcaccagta
44221 tctgacccaa atatccgtca aaaaactgta tcaatgaaat acgtttctga tactaaaaat
44281 atgtcaattg catcaggttt agtaaataac attgctgacc catcacaaat ccttacagaa
44341 gatgctatcg cagttgttgc aaaaacaatt gagtgggctt cattctacgg tgacgcttca
44401 ttaacttctg aagttgaagg tgaaggtcta gagtttgatg gtttagctaa attaattgac
44461 aaaaataacg taattaacgc taaaggtaat caattaactg agaaacactt aaatgaggcg
44521 gcggtacgta tcggtaaagg tttcggtaca gctacagatg cttacatgcc tatcggtgta
44581 cacgcagact tcgttaactc aatcttaggt cgtcaaatgc aattaatgca agacaacagc
44641 ggtaacgtta acactggtta cagcgtaaat ggttttctact catctcgtgg attcattaaa
44701 ttacatggtt ctacagtaat ggaaaatgaa ctaatcttag atgaatcatt acaaccatta
44761 ccaaatgctc cacaacctgc taaagttaca gctactgttg aaactaagca aaaaggtgct
44821 tttgaaaatg aagaagaccg tgcaggatta tcatataaag tagtagttaa ctcagatgac
44881 gctcaatcag ctccttctga agaagtaaca gctacagtat ctaacgtaga cgatggtgtt
44941 aaactttcaa ttaatgttaa cgctatgtac caacaacaac cacaattcgt ttctatctac
45001 cgtcaaggta agaaacagg tatgtacttc ctaatcaaac gtgtaccagt taaagatgca
45061 caagaagacg gaacaatcgt attcgtagat aagaacgaaa cattgcctga aacagcagac
45121 gtatttgttg gtgaaatgtc accacaagta gttcacttat tcgaattact tccaatgatg
45181 aaattaccat tagctcaaat taatgcttct attacatttg cagtattatg gtatggtgca
45241 ttagcattac gtgctcctaa aaaatgggct cgtattaaaa acgttcgtta tatcgcagtt
45301 taatagaata agaaaaactg aatacaagag aatagggata aacttagggt ttatcccttt
45361 tttattaaaa taaacttgaa gggatttaat aaatatgtta tactataaga aactattaga
45421 taaaaaaatg gctactgttt atggtacagt ggagattgac aaagatggag tagtcaaagg
45481 attaactaaa gaacaagaaa aagaatttgc caatgttcca ggttttgaat ttgaagaaga
45541 aaagaaaact actagaaaac aatcagcttc tactagtaaa gaagaagagc ctaaggaaga
45601 ggaaaagaaa gcctctacta gaaaaactac aaatactact agaaaatcta cagcacgtaa
45661 aacaacagcc aaaaaagatg aaaataagta aagggtgaat taaatggtta actcaatgtt
45721 tggagggggac ttagaccctt atgaaaaatc attaaactat gaatatcctt atcatcctag
45781 tggtaatcct aaaacacatag atgtaagtga gatagataat ttaacattag ctgattatgg
45841 atggtcaccg gatgcagtta agcatatat gttcggtatt gtagttcaaa atcctgatac
45901 aggacagcct atgggtgacg agttctataa ccatatattg gaaagagcgg taggtaaagc
45961 tgaaagagca ttagatatat ctatactacc tgacactcaa catgagatga gagattatca
46021 tgagacagag tttaatagtt acatgtttgt acatgcttac agaaaaccta tattcaggt
46081 agagaactta cagctacagt ttaatggtag acctatatat aaataccctg ctaactggtg
46141 gaaagtagag catctagcag gacatgttca attattccct acagcactta tgcaaacagg
46201 acaatcaatg tcatacgatg cagtattcaa tggataccct caattagcag gtgtataccc
46261 accatcagga gcaacatttg cactcaaat gatacgatta gaatatgtat caggtatgct
46321 tccacgtaaa aaagcaggaa gaaataaaacc ttgggaaatg cccccctgagt tagaacagtt
46381 agttataaaa tatgcattga aagaaatata ccaagtatgg ggtaacttaa ttattggtgc
46441 cggtattgct aataaaaacat tagaagtaga cggtattaca gagacaatag gtactactca
46501 atcagctaig tatggtggag ctagtctca gatacttcca ataaatgaag atataaaga
46561 actattagat ggtttaagag cttactttgg atataaatg ataggattaa aaggagggtt
46621 agaaaatgga aaaaccgtat atgataggag ctaactaa ccctaatgtt attaataagt
46681 caacaacata tactactaca acacaagcag atgaacaaga taaacctaag tatactacta
46741 gactagagtt tgatacgatt gacatgatta ggtttattaa tgaccgaggt ataaaagtac
```

```
46801 tatgggaaga agcatatttc tgtccttgtc ttaatcctga tacaggacat cctagagtag
46861 attgccctag atgtcatggt aaaggtattg catatctacc tcctaaagag acgataatgg
46921 caatacagtc tcaagagaaa ggaactaacc agttagatat aggtatatta gatacaggta
46981 ctgcaatagg taccactcaa ttagaaaaga gaatttccta tagagacagg tttactgttc
47041 ctgaggtatt gatgccccaa caaatgattt attttgtgaa taaagataga attaaaaaag
47101 gtataccttt atactacgat gtaaaagaaa taacttatat agccactcaa gacggtacag
47161 tctatgaaga agattatgaa atcaagaata atagattgta tttaaatgaa aaatatgaga
47221 atcatacagt aactttaaag atacttatga ctttaagata tgtagtatca gatatactaa
47281 aagaaagtcg ttatcaatat actaagttta atcaacctaa atcaaaattt gaaaacttac
47341 ctcaaaaatt acttcttaaa agggaagatg tcattgtact acaagaccct tataaagtta
47401 atgatggtat agaagaagac ctagaaattc aagtagatga ccctaaggct tcggcatcta
47461 atcctagtaa tttaggtgga ttcttcggag gtgcatttaa ataatgccag ttcatggaaa
47521 gagacctaat ttatttaaaa ataaaaacta taagcaggta ggtaagagaa caattgatgg
47581 tatgcgttca gaagttcttg ataaattaca agcaacagca cagcaagtag agaatactag
47641 tattaaacgt atgcctactt atctacaaat aacagagaaa aagcttgaaa aagaaggagt
47701 agtagacctt aaaaaagctt ttgctcactc atctaaaaag aaaactagta aagatggcgg
47761 atggtattta actgtaccaa tccgcatcaa aactagtaga atgaataaca gtacttatca
47821 agatatgaga acttaaaag tagataaagg aacaggttca gtttcgaaga taactgatta
47881 cctagaagga cgtaggaaga atgtaagcca cccttcaatg aagcctgaac ctatgactca
47941 taatatgact aaagttaaaa gaggaaagca atcttcttac tttatatta gaactgttc
48001 tagtaagtca cctgctagtt cttggatact taacagagat aaagttaatg aagataactt
48061 ctctaaaaca actctaaaaa ctgttaagca attaatgaac tggaagatga aaaatttaaa
48121 ttaagaggag ggttagtatt aaatggcaat aacatcagtt gattcatatt tattatcaga
48181 aataaagcct agacttaaca ctgtgctaga gaattgttat attatagatg aagtttaaa
48241 agactttgat tatcaaacta gagagagctt taaagaagct ttctgtggta agaatgcaca
48301 acatgaagta acggtaggat ttaacttccc aaaatttaaa aataactatg aagctcatta
48361 cttgatacaa ttaggtcaag gacaagagac aaaaaactct ttagggagta ttcagtcatc
48421 ttactttgag gcaacaggag atacttagt cgaatctct acagcaataa gagaagatga
48481 taagttagtt tttactgttt ctaaaccaat aggagagtta ataaggtag aagatataga
48541 gtttgctaaa tacgataatc ttcaggttga aggtaataag gtatcattta agtatcaaac
48601 aaatgaagat tatgagaact acaatgctaa cattatattt accgaaaaga aaaatgattc
48661 taaaggttta gtaaaaggat tcacagttga agaacaagta acagttgtag gtctttcatt
48721 taatgtagac gttgcaagat gtttggatgc tgtactgaaa atgattttaa tatctatgag
48781 agatagtata gaagagcaac aaacattcca attacagaat ttgtctttg gtgatattgc
48841 accaataata gaagatggtg actcaatgat ttttggtaga ccaacaatta ttaagtacac
48901 aagttctcta gatttggatt atactattac acaagatatt aataaactaa ctttaaaga
48961 aagaaaggat tggaagtagg atggctagaa aaaagacacc tgaaaataac actcctaaat
49021 ttaatggtta tgttcatata gatacattcc ttgatactgc aaaaacccctt tttaatatga
49081 ggggattcaca agtagcagga tttaaagctt atatggaagg tagtcattat ttgtttagtg
49141 agcaagaatt cttaccatca ttagagaagt atctaggtag gaaattagat atataataac
49201 attcagataa ggagaattaa atatggcagt agaaccattc ccaagaagac ctattacccg
49261 tcctcatgca tctattgaag tagatacttc aggtatcggt ggctcagcag gttcaagtga
49321 aaaagtattt tgcttaatcg gtcaggctga aggcggagaa ccaaatacag tttatgaatt
49381 acgtaactat tcacaagcta aacgtttatt ccgttcagga gaattacttg atgcaataga
49441 attagcatgg ggttctaacc ctaactatac agcaggacgt attttagcta tgcgtataga
49501 agatgctaaa cctgcttcag cggaaattgg cggattaaaa ataacatcta aatctacgg
49561 taatgttgct aacaacattc aagtaggatt agaaaagaat acactaagtg attcattacg
49621 tttaagagta atattccaag atgaccgttt caatgaggtt tatgataata tcggtaatat
49681 cttcacaatc aagtacaaag gagaagaagc taacgcaact ttctctctag aacatgatga
49741 agaaactcaa aaagcaagtc gtttagtatt aaaagttgga gaccaagaag ttaagtcata
49801 tgatttaact ggtggagctt atgactacac taatgctatt attacagaca ttaatcaatt
49861 acctgatttc gaagctaaat tatcaccttt cggagataag aacttagaat ctagcaaatt
49921 agataaaaatt gaaaatgcaa atataaaaga taaagctgta tatgtaaaag cagttttgg
49981 tgacttagaa aaacaaacag cttacaatgg tatcgtatct ttcgagcaac ttaatgcaga
50041 aggagaagta ccaagtaatg tagaggttga agcaggagaa gaatcagcta cagtaactgc
50101 tacttcacct attaaaacta ttgaaccgtt tgagttaact aagttaaaag gcggtactaa
```

```
50161 tggtgaacca cctgctacat gggcagacaa gttagataaa tttgcacatg aaggcggata
50221 ctacattgtt ccattatcat ctaaacaatc agttcatgca gaggtagctt cttttgttaa
50281 agaacgttct gatgcaggag aaccaatgag agctattgtt ggtggaggat tcaatgaatc
50341 taaagaacaa ttgttcggta gacaagcatc attatctaat ccacgagtat cattagtagc
50401 taactcaggt acttttgtta tggatgatgg acgtaaaaac cacgtacctg cttacatggt
50461 agccgtagct ctaggtggtc ttgcaagtgg tttagaaatc ggtgaatcaa tcacattcaa
50521 accactacgt gtaagttcat tagaccaaat ctatgagtca atagacttag atgaattaaa
50581 tgaaaatggt attattagta tagagtttgt tcgtaaccgt actaatacat tcttcagaat
50641 cgttgacgat gtaactacat tcaacgataa atcagaccca gttaaggctg aaatggctgt
50701 tggggaagct aatgacttct tagtaagtga gcttaaagtt caacttgaag accagtttat
50761 tggtactcgt actattaata caagtgcttc aatcattaaa gactttatcc aatcttactt
50821 gggtcgtaag aaacgtgata atgaaattca agacttccct gctgaagacg tacaagttat
50881 tgttgaaggt aacgaagcaa gaattcaat gacagtttac ccaatcagaa gcttcaagaa
50941 aatctctgtt agcttggttt acaagcaaca gacattcaa gcctagtcta ggtgacggag
51001 tacctggatt aggtactcct attaatataa tttgaatact ttaggagagt gaatacagat
51061 ggcatcagaa gctaaacaaa ccgtccatac tggtaatacc gtcctactta tgattaaagg
51121 taaaccggta ggaagagcac aatcagcatc aggtcaacgt gaatacggta caactggtgt
51181 atacgaaatc ggttctatca tgcctcaaga acacgtatac ttacgttatg aaggtacaat
51241 tacagtagaa cgtttacgta tgaaaaaaga aaactttgca gatttaggat atgcttcact
51301 tggtgaagaa attcttaaga aagacatcat tgatatttta gtagtagata acttaacgaa
51361 acaagttatt atctcatatc atggttgctc tgcaaataac tacaatgaaa cttggcagac
51421 aaatgaaatt gtaacagaag aaatcgagtt tagttactta acagcaagtg acaaagcacg
51481 tacttaatag attagaccaa ctaaaaagtt ggtcttttt tattgacact ttaaaattta
51541 tatgttatta taatataat aatttaaaca ggagatgtac tagatggcaa ataagagaaa
51601 aacaatagga aaaatgagta acacaagagc aacatggaat attaatccgg taactaaagt
51661 taaaaaagat aaaacaaaat attctagaaa aaataaacat aaaggtcttg acaattataa
51721 ttaactaagg tatattatta gtataacaaa aaaaggagat gggtatatga gtacatttg
51781 gtcagaaaga agaacaacta ataaagatag gcaagttaaa aaacattata ctcaaatgag
51841 tatgtatgaa agaaagaaat gtgtagagtt attacaagag acaattactg aaaatagaat
51901 tattaattt acacgacata gtgcaaaaaa ggttaaaggt aaaccaacaa caaatatacc
51961 taaattaata ggttttattt ttaaaaataa gtttgcctac gaaaatatca tagagtacaa
52021 taacacagat tataatggta atattgagag gagaattgtt gttaaacatc ctaaagttat
52081 aactgtagaa ggaaaaccta gctatcagtt tttgacaatt agtcttgaag atgctagagt
52141 tattacggtg tggtataaca gtgtagatga tacacataga acactagatt taaattatta
52201 tagtaaagac ttgacaattc aataaggagg tattataatg ggtataacaa tagtaaatag
52261 ttattttatt ctgtctagca ttttcctcat catattaacc atattaaatg gtaagggtac
52321 agttacaagg gaatcattaa ctatgagtaa aatattagta gtaataacat caatcaatt
52381 tttagcatgt ttaattatta atggtatttta ttggtcacta aaatttatgt agtagaacta
52441 gaataaaagt attgacaaat taaaactaat aaattataat aaaggtataa caaattaaag
52501 gagaagatat aaaatgtcac aagataaatt aagagcaatt tacacagaaa tgaaagtaga
52561 attacacaaa tttcctaaag aggtagatat aacaagtaaa tcaactgcaa ttgcaatcaa
52621 tcagatttta gataaattca aaacattaac agaacaagca ggaaagatta ctagaaaata
52681 tttagaaggt caagaaatat taactattga ttatgagtat tatgattcat tacaagaata
52741 ctatatttac ctacttagaa atagtgaaaa gattgaacaa agtttacaag aaattactaa
52801 gcgtacaggt gaatatgtaa agtaattttg atttaaaaac aaaatatgat atactatgtt
52861 taaagtagta agcctacact agtccgtgtt atattaatat tgaatcggat aagcgtaggc
52921 tttattaata tttaaaaaag gaaggtatat catatatgg cagaagaaat taaaaaggaa
52981 caagatgtac aagaaacaac taagaagaa aaaaaagatg ttagtaaaat gacaccggaa
53041 gaaatagata aattaaaata tcaagacaaa caagaaaaag aacaagttat taacaaagtt
53101 attaaaggcg ttaatgatac ttgggaaaaa gaatataact ttgaagaact agacttaaga
53161 tttaaagtta agattaaaatt acctaatgca cgagaacaag gtaatatctt tgcgttacgt
53221 tctgcttact taggtggtat ggatatgtac caaacagacc aagtgattag agcatatcaa
53281 atgttagccta ccttacagga agtaggtatt gaagttccta aggaattcca agaccctgac
53341 gatatttata acttatatcc tttaactgtt atgtatgaag attggttagg attcttaaac
53401 tcctttcgtt actaatagta tagaaacatt agataaagat atagaacgat tgggcggtat
53461 ggaatcaatt gttaaacaac ctttatctag aaatctatgg gctattatga aagagtttaa
```

Figure 18 (contd.)

```
53521 tgttttacct accgagcaaa gatttaagga cttagacgat tatcagatag agtttattat
53581 tgggaatatg aatagagatg tttatgaaca taataaacaa cttaaacaag ctcaaaagg
53641 tggaaaattc gatagtcaat tcgaagatga tgatagtagt tggtggaatg aatctcatga
53701 agactttgac ccagtacctg atttcttaga tgctgatgat ttagcacaac agatggaagc
53761 taaattatcc gatagagata aggaagaaag agctaagaga aacgatgcag agttaaatga
53821 tgaaacagaa ggacttacta cacaacatct agctatgatg gaatacatca gacagaaaca
53881 acaagaatta gatgatgaag tagggaaatgg taagactagt gaagatgacg ctactatatc
53941 acaagatagc gttaataaag cactagaaga cctagatgat gactggtata tgtaaagggt
54001 ggtaggtgat actaccatcc ttatttttt aaaatggatg gtgaataatg atggcaatga
54061 atgacgatta tagattggtc ttgtccggtg atagttcgga tttagagaat agtctaaagg
54121 caatagaact ttatatggat tctttagagt ctaagaatat tgatgctcct ttagataatt
54181 tcttaaaaaa attaaaagta attgctaaag aagttaaaaa tgtacagaac gcaatggata
54241 aacaagatgg taaatctgtt atatcttcta aagacatgga tgaatctatt aaatccactc
54301 aatctgctac aaagaatata aatgaattaa agaaagcttt agatgacctt caaaaagaga
54361 atatatctaa aggtattgca cctgaccctg aagttgaaaa agcatatgct aagatgggta
54421 aagttgtaga tgaaactcaa gaaaaacttg agaaaatgtc ttcacaaaaa ataggttctg
54481 atgctagtat tcaaaataga attaaggaaa tgaaaaccct aaatcaagta actgaagaat
54541 acaataaaat aagtaaagat tctagcgcaa ctaaagatta tacaaaacga ttaagagcta
54601 atcgtaatat gactgagggt tacatggagc gttcagaagg aacaggacgt ttgacatatg
54661 accaaggtgc acgagttaga agtgaactag gtaaagtaag ttcttatgag agccaaagaa
54721 aacaaaacca acgtaatttg gaacaagcaa gagaacaata tagcaactat agaaaccaac
54781 aacaagactt gactaaacgt agagctagcg gtcaaattaa taaggcacaa tatgaacaag
54841 agttagcttc tattaaacag gaaatgaaag ctagagaaga acttatatct aactatgaga
54901 aattaggagc agaacttgat aaaacagttc agtattataa gggttcagtt caaaaggatt
54961 tccaatctag agacgtagac caacaaagag gaacatttgg tagaatggtt caagaacgtt
55021 tgccatctat tggttctcat gctatgatgg gtactacagc tatggctaca ggtttataca
55081 tgaagggtgc ctcactaagt gaaactaata gacctatggt tacatcatta ggtcaaaatt
55141 ccgataatat ggatatagat tctgtaagaa atgcatatgg agacttgtca attgataaca
55201 aattaggtta taatagtact gacatgttga aaatggctac ttcatatgaa gcatcagtag
55261 gacataaaag tgatgaggac acaatggcag gaactaaaca gcttgctatt ggaggacgtt
55321 ctttaggcat taaagaccaa gaagcttatc aagagtctat gggtcaaatc atgcataccg
55381 gtggagtaaa ttctgataac atgaaggaaa tgcaagatgc attcttaggt ggtattaaac
55441 aatcaggcat ggttggtcgt caagatgaac aacttaaagc actaggttct atagcggaac
55501 aatcaggaga aggaagaact ctaactaaag accaaatgag taaccttact gccatgcaat
55561 ctactttgc agagtcagga agtaaaggat tacaaggtga acaaggtgcc aatgctatta
55621 acagtataga ccaaggactt aaaaatggta tgaatagttc ttatgctcgt atagcaatgg
55681 gatggggaac gcaataccaa ggtcttgaag gtggatatga tttacaaaaa cgtatggatg
55741 aaggtatatc taatcctgaa aactlgacag atatggctga tatagctact caaatggggtg
55801 gcagtgaaaa agaacaaaaa tacctattta atagaagtat gaaagaaata ggcgctaacc
55861 taactatgga gcaatctgat gaaatattta aggactctaa agaaggaaaa ctgtctaaag
55921 aagagttagc taagaaagct aagaaaatgg aaaaagaagg taaaaaagaa ggagaagata
55981 acgccactga ttataagaa tctaaatcag gaaaaaatga ccaaaataaa tctaagactg
56041 atgataaagc agaagatact tatgatatgg ctcaaccact aagagatgct catagtgctt
56101 tagcaggtct tcctgccct atatatttag ctattggtgc tataggagca tttacagctt
56161 cactaattgc atctgcaagt caattggag caggtcactt aattggtaaa ggagccaaag
56221 gacttagaaa taaattggt agaaataaag gcggtagctc cggtggtaac cctatggcag
56281 gtggaatgcc tagtggtggt ggttcaccta agggtggagg ctcacctaaa ggtggggga
56341 ctcgttctac tggaggaaaa atacttgata gcgctaaagg tcttggagga ttcctagtag
56401 gtggcgcagg atggaaaggt atgttggcg gggagtctaa aggtaaaggc tttaaacaaa
56461 catctaaaga agcctggtca ggtactagaa aagtatttaa tagagataat ggtagaaaag
56521 ccatggataa atctaaagat atagctaaag gtaccggtag tggtcttaaa gatatctata
56581 atgatagtat atttggtaaa gaaagaagac aaaacctagg agaaaaagct aaaggttttg
56641 gtggcaaagc taagggtctc tatgtaagt ttgctgataa gtttggtgac ggaggtaaaa
56701 atggtatct ttcacaatca ccaaaagcag gtggaagtgg catgggaaa cttggaaac
56761 ttgcaggtgg acttggaaaa ggagccggag ttttaggtgt tgctacgtct gccttatcat
56821 taatacctgc tttagcttcc ggagatagta aagctatcgg cggaggaata ggctctatgg
```

Figure 18 (contd.)

```
56881 gtggaggaat ggcaggtgca tcagcaggag cttctatagg agctttattt ggtggtgtag
56941 gtgcaatacc tggagcttta ataggtggag ctataggttc cttcggagga ggagctgttg
57001 gtgaaaaagt cggagacatg gctaaaaaag ctaacactaa agaaggatgg aacctaggat
57061 ggactaacgg agataaggat ggtaagaata aattccaaga ttctttatta ggaaaaccta
57121 tatctaaagc atggagcggt ataacaggtc tctttgataa tgacgctgaa gcatccgaag
57181 aagatagtaa agataagaaa aaaggtgtta aaggcgttaa aggagatact aagaagaaag
57241 aaaaaatgac agcagaacaa cttagagaaa agaataacca atctgaaact aagaatctta
57301 aaatctatag tgatttactt gacagagctc agaaaattat tgagagtgct aaaggtatta
57361 atatagatgg aggaacttct gatagtggtt ctgatagtgg aggctctgca tctgatgtag
57421 gtggagaagg cgcagagaag atgtacaagt tccttaaagg aaaaggacta tctgataatc
57481 aggtaggagc tgttatgggg aacttacaac aagaatctaa tcttgaccct aatgctaaga
57541 atgcttctag tggagcattt ggtattgctc agtggttagg ggctagaaaa acaggattag
57601 aaaattttgc taaatctaaa ggtaaaaaat ctagtgacat ggatgttcaa ttagattacc
57661 tatggaaaga aatgcagtct gattatgaaa gcaataatct taaaaatgca ggttggagca
57721 aaggtggaag cttagagcag aatacaaaag cattgctac tggatttgaa cgtatgggag
57781 caaacgaggc tatgatgggt actcgtgtta acaatgctaa ggaattcaag aagaaatacg
57841 gaggctccgg tggcggaggt ggtggaggag ccctatcctc tacttaccaa gaagctatga
57901 gtaatcctgt attaactact ggttctaatt ataggggctc taatgatgct tctaatgctt
57961 ctacaactaa cagaataacc gtcaatgtta atgttcaagg tggaaataat cctgaagaaa
58021 ctggagacat tatcggagga agaattgag aagtctaga tagtaacatg gatatctttg
58081 caaatgaaca taagagaagt tattagtaat tttgtattga cacaagagta gtatcatagt
58141 atactactct tatacatata aaaaataaaa ggaagtatgt gtatatgcgt agaataagaa
58201 gacctaaggt aagaatagaa atagttacag atgataatac atttacattg agatttgaag
58261 atacacgaga ctataatggt gatgagtttg gagctaaact tttaggattc caaactaaaa
58321 actctatgga agatgatagt tcagttttcc aaataaatat ggcaggagat acttattggg
58381 ataagctagt tatggctaat gatatcataa gaatatttat tacacctaat gatgaccta
58441 acgataaaga aggaaaacaa gaacgactta tccaggtagg tatggttct caagtatcaa
58501 aagtaggtag ttacggtaat gaccaaactc aatttagaat aacaggtcaa tcttttgtaa
58561 aaccttttat gaaatttgga ttaggcgtta ttcaggaagt tcaagctgta ttacctgaag
58621 taggttggct tattgatggt gatggagata atgaagtaaa atttactggt agctcagctc
58681 atgaagtaat gactggtatt atacgtagat ttatacctta tatgaaatat aactatactg
58741 aaaaaacata taatacaatt gataactatc ttgattatga tgatttaagt agttgggatg
58801 agtttgaaaa acttacagaa gtttcagcct ttactaattt tgatgggtca ttaaaacagt
58861 taatggatat ggtaacagct agaccttta atgagttatt cttcaaaaat tcagaaaaaa
58921 cacctggaaa ggctcaactt gtattaagaa agaccccttt taatcctact gagtggagag
58981 ctttagatat gattaaagta cctactgagg attttataga agaggatgta ggtaaaagtg
59041 atgtagagac atattctata tttacagcaa caccctgcagg tatgttgaaa gagcttaacg
59101 gtgatgtatt ttctaaacca caattccacc ctgaattaac tgatagatat ggttatacta
59161 aatttgaagt agaaaatatt tatcttagta caaaatcagg ttcagctact gaggattcag
59221 atcttcagg tgatgataat ggcacagaac gaggaactta ttctaaaatt atgaaagatt
59281 taagtaacta tggaagagat aatatatcta aaggtataga taagtataca agtaaattat
59341 cttcaaaata taaaaactta aaaaaagccc aagctaaaaa aattatagag aagtttgtta
59401 aagaaggaaa agtaacagaa aaagaatatg aaaaaataac aggtaataag gtagatgatg
59461 aattaacatc agataacaga ccgaagttga caaaagataa attaagagt atactaaaag
59521 agaagtttaa aacacaagat gattttaata attctaagaa aaagaaaaaa gctaagacag
59581 atgcacttaa agaattgaca actaaatatc gttttggtaa taaacacat gctacaactt
59641 tattagatga atatatttaaa tataaggag agccacctaa cgatgaggct tttgataaat
59701 atcttaaagc tattgaaggt gttagtaatg tagctacaga cacaggttca gatgcaagtg
59761 atagcccttt agttatgtt tctagaatgc tatttaattg gtatcatggt aaccctaact
59821 tctatgcagg agatattatt gttttaggag accctaagta tgacctaggt aaaagattat
59881 ttattgaaga taagcaacga ggagacactt gggagttcta tattgaatct gtagaacata
59941 aattcgatta taaacagggg tattatacaa ctgtaggagt aactagaggt ttaaaagacg
60001 ctattctaga agatggtaaa ggtagtccgc atagatttgc aggattatgg aatcaatcat
60061 cagacttcat gggaggtctt atgggtgaag atacttctaa agaacttaaa gaaaaggtg
60121 tagcagagaa acaaagtagt ggagataaag atggtggttc tgatagtggt ggagctcaag
60181 atggtggctc tttagattca cttaaaaaat ataacggcaa acttcctaag catgacccaa
```

Figure 18 (contd.)

```
60241 gttttgttca acctggtaac cgacattata agtatcagtg tacatggtat gcttataata
60301 gaagaggtca attaggcata cctgtgcctt tatgggggga cgccgccgac tggataggtg
60361 gtgctaaagg agcaggttat ggtgtaggta gaacacctaa acaaggtgct tgtgttatat
60421 ggcaaagagg agttcaagga ggtagcccac aatatggtca cgtagcgttt gtagagaaag
60481 tattagatgg aggtaaaaaa atatttatct ctgaacataa ctatgctacc cctaatggat
60541 atggtactag aacgatagat atgagttcag ccataggtaa gaatgcacaa ttcatttacg
60601 ataagaaata aaggaggata gtctatggca acagataaag aagctaaaga tgttattgat
60661 aaatttatag acaatgtatt taattttgat gtacttacaa aagaaagaat aaaagaaaaa
60721 gatgaagaaa ttaaaaaaat aactacagat gatatgtatg aaaaggttgt gtatatacga
60781 cctatgttg gagtaataca aagccttaac cctcagcatg ttcagtatga atcattttct
60841 aataatggtt atgatatagga ggcagaatta agtttcagga aagtaagtta tttagttgat
60901 aaagggtcta tacctacaga ttctttatct actttaacag ttcatttagt agaacgaaat
60961 caagaactat taatagatta ctttgatgag atacaagatg tgttgtatgg agaatatatg
61021 gaagaagaat atgtatttga tgaagatgta ccattaagta cgatactagc attagactta
61081 aatgataatc ttaaatcctt atcaaatata aagtatatgt tcaaaggtgc tcctaaagag
61141 aatccatttg gaacagataa agatgtttat atagatactt ataacttatt atactggtta
61201 tatttaggtg aagatgaaga gttagcatat cctatgaata ttaactactt ctttacagag
61261 ggaagattct ttactatatt cggtaaagga cataagtata aggtagatgt tagtaaattt
61321 atagttggag atatatatt ctttggtaga agtgatacta atataggtat ttatgtagga
61381 gatggggagt ttatatctat gatgggtaaa ttccctaaag atgaaacacc tataggaaaa
61441 tataaactg atgattactg gaatgaattt aacggaagag ttatgagatt cgatgaagag
61501 gtgtatattt aatggtagta agattccaat cttccatggg gagaagttta aaaagagtag
61561 attcggatga tttaaatgta aaaggattag ttttagctac agttagtaaa attaattata
61621 aatatcaatc agtagaagtt aaagttaaca atttaactct aggaagccgt ataggtgatg
61681 atggtagctt agctgtacct tatcctaaat ctttcatagg aagaacacct gaaggaagcg
61741 tattcggtac aaaacctctt attactgaag gttctgtagt attaataggg tttctaaatg
61801 atgatataaa tagtccctatt attttaagtg tttatggtga taatgaacaa aataaaatga
61861 ttaataccaa tcctctagat ggaggtaagt ttgatacaga aagtgtttat aaatatagta
61921 gttcactata tgaaattta ccatctttaa attataaata tgatgatgga gaaggaacaa
61981 gtattaggac ttataatggt aaatcatttt tctctatgac atcaggtgaa gaagagaaac
62041 ctcaggcaac agattttat actggaactg agtatcaaga tttatttact tcttattatg
62101 gtaataagac attaattgag cctagaatac aaaaggctcc taatatgtta tttaaacatc
62161 aaggagtttt ttatgatgat ggcacgccgg ataatcatat aactacttta tttatatctg
62221 aaagagggga tataagagcc tcagttttaa atacagaaac acagaaaaga actacacagg
62281 aaatgtcaag tgatgggtct tatagagtta tcaaacaaga tgacgattta atgttggatg
62341 aagctcaagt ttggattgag tatggtatta gtgaagataa taatttttat attaaaaatg
62401 acaagcataa atttgaattt actgatgagg aaatctatat agatgataaa cctatgttag
62461 aaaacttaga tgagagtata gcagaggcta tgaagaattt gaatgaaata caaaaagaac
62521 tcgatgatat aaactacctt ctcaagggtg taggtaaaga caatttagaa gaattaatag
62581 agtctacaaa agagtctata gaagcttcta aaaaagcaac ttcagatgtc aatagactta
62641 caactcagat agcagaagtg agtggtagaa ctgaaggtat tataacacag ttccaaaaat
62701 ttagagatga gacttttaaa gatttttatg aagatgcttc tactgttatt aatgaagtaa
62761 atcagaattt ccctactatg aaaacagatg ttaagacctt aaagactaaa gttgataacc
62821 tagagaaaac tgaaatacca aatattaaaa ctagattaac agaactagag aacaataata
62881 acaatgctga taaaataatc tcagatagag gagaacatat aggtgctatg atacagttag
62941 aggaaaatgt cacagtacct atgagaaaat atatgccaat accatggagc aaagttactt
63001 ataataatgc agagttttgg gattctaata atcctactcg attagtagta cctaaaggaa
63061 taacaaaagt aagagttgca ggtaatgttt tgtgggactc taacgccaca ggacaacgta
63121 tgttgagaat attgaaaaat ggtacttata gtataggatt accttataca agagatgtag
63181 ctatatctac agcacctcag aatggtacta gtggagttat tcctgttaaa gaaggagatt
63241 actttgagtt tgaagctttc caagactcag aaggtgacag acaattcaga gcagacccct
63301 atacatggtt tagtattgaa gctatagaat tagaaactga aactatggag aaagacttta
63361 tgcttatagg acatagagga gcaacggat acacagatga gcacacgata aaaggatatc
63421 aaatggcttt agataaaggt gcagattata tagaattgga tttacaatta acaaaagata
63481 ataagttatt gtgtatgcat gattctacta tagacagaac aacaacagga acaggtaagg
63541 taggagatat gaccttatct tatatacaaa ctaactttac atctctcaat ggtgagccga
```

```
63601 taccatctct tgatgatgta ctaaatcatt ttggaacaaa agttaaatat tatatagaaa
63661 ctaaacgtcc gtttgatgct aatatggata gagaattatt aactcaatta aaagcaaaag
63721 gattaatagg aataggttca gagagattcc aagtaattat tcaatcattt gctagagaat
63781 ctttaattaa tattcataat caattctcta atataccttt agcttaccta acaagtacat
63841 tttctgaaag tgaaatggat gattgtttaa gttatggttt ttatgctatt gcgcctaaat
63901 atacaactat aactaaagaa ttagtagatt tagctcatag taaagggctt aaagtccatg
63961 catggacggt aaacacaaaa gaagaaatgc aaagcttaat acaaatgggt gtagatggat
64021 tctttacaaa ctacctagat gaatatataaa agatttaata ttaaagacct attaatttag
64081 gtctttttt agttgtaatt taaactagtt cgtgatatat tagtagtatg agatttatat
64141 acatactgaa aaggagagga taaaatgcca caatcagatg gaataagtaa tcttcataga
64201 atagctttac gcttccctaa agaaggcggt ggttatgata tgtatagatt taaagttaac
64261 cctgagaact acacaataga ttcaccacaa cgtacgacag caattaaaac aaaatcagat
64321 attgtaatag aagattatgg taaagacata gaagttatta acttcacagg tacaactggt
64381 tttagacctg ttagagaagc agatggatta aaaacaggta agcagaaaat ggaagagtta
64441 caaagtagag ttagtgaata tgctatgcaa ggtggcagtg gtaatgtaag tggttcttac
64501 ttacaatttt ttaactttac agatgatagt tattataaag ttcatttagc tcctcagggg
64561 ttaaagataa ctaggtctaa agatgaacca ttactttta gatatgaaat aacattagta
64621 gttattggtt cattaacaga agcagataga agtgctgtaa caacagaaga gtttggtaac
64681 gttaaaccta atgcttctca aagagtagat gagggtataa aagaattaga taaaaatgct
64741 cgtaaaacga gagatagaaa caatcaagaa atatctagaa gagaaaatac aatacctaaa
64801 tctacaggag ataatacgaa cgagggtaat agacttaagc aaagcttccc tagtagttct
64861 atatataatc ctagacaatc tactaacgga ttaaaaggta atattgacaa tatggcgctg
64921 ataataggtt acggtgatgg aggtgtatct agctaatgaa taatttata ccacaacctc
64981 aaggtctact tagattttta aatacctag atacagatt aactctct catatgaatt
65041 tactggatga agaggtatca tttgtatcta aatttatac accacagcta caattaagtg
65101 aattagcaaa aaaagtattg acaaatataa agacagatga tatacctgta ttagaaagag
65161 aatttaatga taatacaatt atccataaag ctaacgatac attactaaaa gtacaggctc
65221 caagaatgta tatgattcta cagtcgattg tacttgaagc atatgctatt gttaattgct
65281 ttgtagaaaa tccgagctct ttaaaatact taactgaaga agatgttagt ataacacggg
65341 aaaatttaaa ttatgtagct gactactag taactatga tgactataa agtgttgtct
65401 tagacttaag agatttagac ttatgtttta gtgctataga attacaatta cctctaatca
65461 aaaaggaggc taacgtataa tgagatttaa gaagcacgta gttcaacatg aagaaacgat
65521 gcaagcaata gcacagagat actatggtga tgtgagttat tggatagacc tagtagagca
65581 taataattta aagtaccct attagtaga aactgatgaa gaaaaaatga aagaccctga
65641 acgattggct tctacaggtg atacactgat tatacctata gaatctgatt taacagatgt
65701 atcagcaaaa gaaattaatt ctagagataa agatgtacta gttgaattag ctttaggaag
65761 agatttaaat attactgcag atgaaaagta ttttaatgaa catggtacta gtgataatat
65821 actagcattc agcacaaatg gtaatggaga tttagatact gtaaaaggca tagataatat
65881 gaaacagcaa ttacaggcac gtttattaac tcctagaggt tctttaatgc tacatcctaa
65941 ttacggttca gatttgcata atttatttgg tcttaatata cctgaacaag ctacattaat
66001 agaaatggaa gtattgagaa cattaacatc agataataga gtaaaatctg ctaatctaat
66061 tgattggaaa attcaaggta atgtttattc aggtcaattt tcagtggaaa taaaatctgt
66121 tgaagaatca ataaattttg tcttaggaca agatgaggaa ggaattttg ctttatttga
66181 ataggaaagg attaaattat gaaaactaga aaattaacta acatactatc aaaattaata
66241 gataagacaa tggcaggtac aagcaagata acagacttta ctcctggttc agcttctcgt
66301 tcattattag aagctgtatc attagagata gagcaattct atattctaac aaaagaaaat
66361 attgattggg gtacaagaa aggtatcatt gaagcttttg attttcaaaa aagacaatct
66421 aaaagagctt atggtgatgt tactattcaa ttctaccaac cctagatat gagaatgtat
66481 ataccccgcag gaacaacttt tacttcaaca cgcaagaat accctcagca atttgaaaca
66541 ttagttgatt attatgcaga gcctgattct actgagattg ttgttgaagt ttattgtaaa
66601 gaaacaggggg ttgcaggtaa tgttcctgaa ggaacaatta atactatagc atcaggttct
66661 agtttgatta gaagtgttaa taacgagtat tcttttaata caggaactaa agaagagagc
66721 caagaagact ttaagcgcag attccactct tttgtagaat ctagaggtag agcaactaat
66781 aaatcagtaa gatatggtgc actgcagata cctgatgtag aaggtgttta tgtttatgaa
66841 gaaacaggac atattacagt atttgctcat gatagaaacg gtaatttatc agataccta
66901 aaagaagata taattgatgc tttacaagac tatagaccaa gtggtataat gttagatgtt
```

```
66961 acaggtgtag aaaaagaaga agttaatgtt tctgctacag taactatatc taataaatct
67021 agaattggtg atacattaca aaaacatatc gaaagtgtta ttagaagcta tttaaataat
67081 ttaaaaactt ctgatgacct aataattaca gaccttattc aagctataat gaatattgat
67141 gatgtattaa tatatgatgt gtcatttgat aacctagatg agaacattat agtaccgcca
67201 caaggaatta ttagagcagg agaaataaaa gtagaactaa agtaaagaga ggtgaaactt
67261 aagtcgtggc taatttttta aagaatcttc atccattatt aagaagagat agaaataaaa
67321 aagataatca agaccctaac tttgctctga tagatgcact caatgaagag atgaatcaag
67381 tagagaaaga tgctatagaa agtaagttac aatcttctct aaagacatct accagtgaat
67441 atttagataa gtttggggat tggttcggag tttatcgtaa gaccgatgag aaagatgatg
67501 tttatagagc aagaattata aaatatttac tcttgaaaag aggaactaat aatgctataa
67561 tagatgctat aaaagattat ttaggtagag atgatattga tgtaagtgta tatgaaccTt
67621 ttacaaatat tttctatact aacaaatcac atttaaatgg tgaagaccac ttaatgggat
67681 actattatag atttgctgtt attaatgtct ctataggtga ttatttccct gtagagatta
67741 tagatgtaat taatgaattc aaacctgcag gtgtaactct atatgtcact tatgatgggg
67801 cttctactat tagaggtgga gcaattatta agtggttaga tgggttacct aaaatagaaa
67861 cataccaaga gtttgataga tttacaggtt atgatgatac attctatggt catattaata
67921 tgaatcaaag taaagatact gataacagtt catcagatat ttttaaaaca aaccatagct
67981 taattaatag tttagatgtt ttaacaggtt catctagtgt agggagacag tatattaact
68041 acggatatgt aacatcatat gtttataatc caggtatgac atcttctgta aatcaaataa
68101 gcgctagtac agaaggtaga ggtcaagaag tacctactga ctattatatg tatactagta
68161 ctaagaataa caatacagta gaacttagta tgcaaaactac ttccggtgtg tcttatttat
68221 ataataactt taattttagg gactatatga gtaaatatag acctcaagta gatttacaat
68281 ctgatgaggc tagaagaatt gtatctgatt atataaaaga attaagtatt gattactatc
68341 ttagtgctgt gatacctcct gatgaaagta tagaaattaa actacaagtt tatgattttt
68401 ctattaatag atggcttaca gtatcaatta ataatttatc ttctatgaa aaaaatatcg
68461 ggagcaatat aggatatata aaagattatc taaacagtga attaaatatg tttactaggt
68521 tagagataaa tgcaggtaaa agagattcag tagatattaa agttaattac ttagatttaa
68581 tgtttatta ctatgaacga ggtatttata caataaaacc gtataaagca ttaatagaaa
68641 attatttaga tatatctaga gagacttatg tagaagcatt taaaatagca tcattatcta
68701 atggagatat taactaaa acaggtttc agcctatagg gtatttaaaa ctagttggta
68761 attatgaaaa tacaatacct agcacaataa atatagtagc taaagataca gataataacc
68821 ctatagaatc taatgaatta gatgtatata atacagtaga gaatagaaat ttattacaat
68881 cttataaagg tgtaaatacg atagctagag aaataacttc tacaaaagag tttactgtat
68941 caggatgggc taaagagata tactcaacta attatctttc taaagtatta aaaccaggta
69001 aagtgtatac gttatctttt gatatggaaa taacaggtaa tgacccaact cttaaatctt
69061 attctgataa tcatggtata tatttataca gtaatactaa gggaattgtt gttaatggtg
69121 ttaaatctat ggaacgtact ataggtaaca aagtatccgt aactcaaact tttacagccc
69181 ctactattac tgaccataga ttactaatat atactggaag atatacatct gatggtaaag
69241 catcaactcc tccagtgttc tttaatacag ttaaaattac ggaattaaaa ttgactgagg
69301 gttcttctaa gctagagtac tcacctgctc cggaagataa acctaacgta atagaaaaag
69361 gaattaaatt taataatatc ctaactaata tacagacttt aagtattaat tcggatacta
69421 tcttaaaaaa tgtaactttta tattattctt actatggtga tagttgggta gaactaaaga
69481 ctctaggaaa tattagtact ggagaaacaa cagaaaccaa taactaata gatttatatg
69541 gattacagac agtagattat tctaatataa atccaatgtc taagtatca ttacgttcca
69601 tttggaatgt taagctaggt gaattgaaca atcaagaagg ttctttatct aatatgccta
69661 atgattactt taatgctgta tggcaggata tagataaatt atcagatatt gagctaggtt
69721 ctatgagaat ggttaaagac actgagggcg gagtattcga tggagctaca ggtgaaatta
69781 ttaaggctac tctatttaat gtcggtgctt atactgattt agatatgtta gcctatactt
69841 tgactaatta tactgaaccg ttaacgttag gctctagtcg ataataagt gagctaaag
69901 aagaactact aacatcagaa tcattaatg tcgataatag aattaaagta attgactcaa
69961 tatatgagga gttaccaaat acaagcatta ttaaaaatgg atttgttgaa agagaagtta
70021 caggttctaa atatttagat tacgtttat atgagcctat agaagatggt actagatata
70081 aacttattgt cgaaggagaa tttaaagata atatagaatt tatatctta tacaattcta
70141 acctaacTt taatgaaaca tttatatatc catcagagat aattaatgga gttgctgaaa
70201 aagaattttat tgcaaaacca tctactgaag acaaaccaag gttaaataca gatgttagaa
70261 tatatatacg accttatgat tcaactatct ctaaagtaag aagagtagaa ttaaggaaag
```

Figure 18 (contd.)

```
70321 tttaataaat aagttgacag aaagttaata atatggtata cttataaagt aatatttagt
70381 ggtataccat gttatattaa taaagaaaac aacagatgaa aggaattaaa aaatatggca
70441 attgcaacgt ataattctca tgttgagtta gcaaaatatc tagttagtaa agctgattca
70501 gtttacttaa caattggaaa gagcacaccg tggtctaatg aaacaaaccc accgcaacct
70561 gatgaaaatg caacagtatt acaggaggtt attggatata aaaaagctac taaagttact
70621 ttagttagac cttctaaatc acctgaagat gataataaga atttaatttc ttatggtaat
70681 aaatcgtggg tagaagtaac acctgaaaat gctaaagctg aaggagctaa atgggtttac
70741 ttagaaagta gtattgttgg tgacgaacta cctcttggaa cgtacagaca ggtaggattt
70801 gttatggact tagtagcaaa aagtggtatt agtaaattta acttagtacc tagtgaagta
70861 gaatcaactg gaacattatt attctttgat aataaacaat tccaaaatag aagtgagcag
70921 acaactgcta aagaaagatt tattgtagaa gtttaaaagga ggatgattat ttatggtatt
70981 cacattagag gatttcgtgg gagattggcg acagacggca ggttataact tagaccaggt
71041 tttagagcaa ggtggtgtat cttctttgtt tcagaacttg ggagtcagtg ttacacctat
71101 tcagcgtata gtcttgagtg gtgagaacgg attaaagatt gatatccatg tcattattcc
71161 ttacgaagga ttgtcaggag atcaaatggg acagatcgaa aagatttca aggtagtgta
71221 cccagtcgat gaccaccact tcaaggtaat attgcactat ggtacattgg taatcgacgg
71281 agtaacacct aacatgatag actatttcgg aagaccttac gagggtatcg cggtcttcga
71341 tggtaagaag attactgtca cgggaacttt gtggaacggc aacaaaatca tagacgagag
71401 attaataaac cctgacggaa gtttgttgtt tcgagtgaca ataaacggag tgactggttg
71461 gagattgtgc gaacgtatat tagcttaata aagaaaggga gataattcta aatggcaatt
71521 aattttaaag gttcaccta tttagataga tttgaccgt ctaaagatag aacaaagta
71581 ttattaatc ctgatagacc tctacaacag gcagaattaa atgaaatgca gtctatagac
71641 caatattatt taaaaaatct aggtgatgca atattcaaag acggagataa acaatcaggg
71701 cttggattca cattgtctga agataatgta ttgacagtaa atcctggtta tgtatatc
71761 aatggtaaaa taagatatta cgataatgac gattcagtta aaataactgg cgtaggtaaa
71821 gaaactattg gtattaaatt aacagaacgt attgttacac ctgatgaaga tgctagccta
71881 ttagaccaaa ctagtggagt accaagttac ttctctaaag gtgcagatag attagaagaa
71941 aagatgtcat taacagttaa tgacccgaca tcagcaacta ttatactttt catggatggg
72001 gatttatata ttcaatcaac taatgctgag atggataaa tcaacaaagt attagctgaa
72061 cgtacttatg atgagtcagg ttcatataaa gtaaatggtt ttgaactatt tcagaaggt
72121 aatgctgaag atgatgacca cgtttctgta gttgtagatg caggtaaagc ctatgtaaaa
72181 ggttttaaag tagacaaacc cgtatcaaca agaattagtg tacctaaatc ttatgactta
72241 ggaacagcag aaaatgaaag tactatcttt aataagtcta ataactctat tagtttagct
72301 aatagccctg taaaagaaat tagacgtgtt acaggtcaag tacttattga aaaagaacga
72361 gttacaagag gagctcaagg tgatggtcaa gattttcttt caaataatac agcatttgaa
72421 attgtaaaag tttggactga aacaagccct ggagttacta caaaagagta taaacaagga
72481 gaagacttca gattaacaga tggtcaaaaca attgattggt cacctcaagg tcaagaacct
72541 tcaggaggta cttcatacta cgtttcttat aaaatataaca aacgtatgga agccggtaag
72601 gattatgaag taacaactca aggtgaaggg ttaagtaaga aatggtacat taactttaca
72661 ccttcaaatg gtgctaaacc tattgaccaa acagtagtat tagtagacta tacttactac
72721 ttggctcgta aagattcagt gtttattaat aagtatggtg atattgcaat attacctggt
72781 gaacctaata ttatgagatt agttacacca ccattaaaca cagaccctga gaatttacaa
72841 ttaggtacag ttacagtatt acctgattca gatgaagccg tatgtatttc atttgcaatc
72901 actagattgt ctatggaaga cttacagaaa gttaaaacaa gagtagataa cttagagtat
72961 aaccaagcag taaatgctct agatgatggt gctatggaag gacagaaccc tctaacatta
73021 cgttcagtat tcagtgaagg tttcattagt cttgacaaag cagacattac acatcctgac
73081 ttcggaattg tattagttt tgaagatgca gaagctactc tagcttatac agaagcagtt
73141 aaccaaccta agattattcc aggagataca acagctcata tttggggtag attaatttca
73201 gcaccattta ctgaggaacg tacaatctac caaggtcaag catcagaaac attaaatgtt
73261 aacccttata atattcctaa caaacaaggt gtgttaaaat taacacctag tgaggataac
73321 tggattgata ctgaaaatgt tacaatcact gaacaaaaaa ctaaaaaagt aactatgaaa
73381 cgattttgga gacataatga aagttactat ggtgagactg agcattactt gtattctaac
73441 ttacagttag atgcaggaca aaagtggaaa ggtgaaactt acgcttatga tagagagcat
73501 ggtcgtaccg gtactttatt ggaatcagga ggacaacgta ctctagaaga aatgattgaa
73561 ttcattagaa tcagagatgt atccttcgaa gttaaaggac taaaccctaa tgataataat
73621 ttatatttat tatttgatgg agtaagatgt gctataacac ctgcaactgg ctatagaaaa
```

Figure 18 (contd.)

```
73681 ggctctgaag atggtacgat aatgacagat gctaaaggaa cagctaaagg taagtttact
73741 attcctgcag gtattcgttg tggtaaccga gaagttacac ttaagaatgc taactctaca
73801 agtgctacaa cttacacagc ccaaggacgt aaaaaaaccg ctcaagatat tattatcaga
73861 actcgtgtaa cagtaaactt agtagacccg ttagcacaat cattccaata tgatgagaat
73921 agaactatat catcattagg attatacttt gcttctaaag gtgataaaca atctaatgtt
73981 gttatccaaa ttagaggtat gggtgaccaa ggttatccta ataaaacaat ctatgcagaa
74041 acagttatga atgctgatga tattaaagta tctaataatg ctagtgctga aactagagta
74101 tacttigatg accctatgat ggctgaaggc ggtaaggagt acgctattgt tattattact
74161 gagaacagtg attatacaat gtgggtaggt actagaacta agcctaaaat tgataaacct
74221 aatgaggtta tttcaggtaa tccataccta caaggtgtat tattcagttc atcaaacgca
74281 tcaacatgga ctcctcacca aaactctgac cttaaatttg gtatttatac ttctaaattt
74341 aatgagacag caacgattga attcgaacca attaaagatg tatcagcgga tagaatagtt
74401 cttatgtcta cgtacttaac tcctgagaga acaggatgta cgtgggaaat gaaattaatt
74461 ctagatgata tggcatcttc tacaacattc gaccaattga aatgggagcc tatcggtaac
74521 tatcaagact tagatgttt aggtctagca agacaagtta agttaagagc aactttcgaa
74581 tctaatagat atatctcacc attaatgagc tctagtgatt taacattcac tacattctta
74641 acagagttaa caggttcata tgttggtaga gctattgata tgacagaggc tccttacaat
74701 acagtaagat ttagttatga agctttctta cctaaaggta ctaaagttgt tcctaagtat
74761 tctgcggatg atggaaaaac ttggaaaaca tttactaaat cccctacaac tactagagcc
74821 aataatgagt ttacacgcta tgtcattgac gagaaagtaa aatcatcagg aacaaatact
74881 aaactacaag ttagattaga tttatcaact gaaaatagct ttttacgtcc tcgtgttcgt
74941 agacttatgg ttactactag ggatgaataa actagagggg ttgattgacc cctcttttatt
75001 taataaggag agatttatat gcctagagaa gttagagacc cttattctca agctaaatta
75061 tttataccta cagttgagga aaaatcaatt aaggaattag aaaaaaacata caaagaaaaa
75121 attgatgaag ctactaagtt aatcaatgaa ttaagaaaag agagaggaga aaaatagatg
75181 gcatttaact acacgcctct tactgaaaca cagaagttaa aagatatgta tcctaaagtt
75241 aatgatatag gtaactttt aaaaacagaa gttaacctta gtgatgtaaa acagatatca
75301 caacccgact ttaataatat tttagcatct atacctgata gtggtaacta ttatgtaact
75361 aattcaaaag gtgctcctag tggagaagct acagcaggat ttgtaagatt ggataaaaga
75421 aatgtaaaat attataaaat ttactattca ccatatagca gtaacaaaat gtatatcaag
75481 acttatgcta atggtactgt atatgattgg attagtttta aattagatga aggtagctta
75541 tacaatgaag gtaatacttt gaatgtaaag gaacttactg aatccacaac tcaatatgca
75601 acactagtta atcctccaaa agagaaactta aatacaggtt gggttaatta caaagaaagt
75661 aaaaatggtg ttttcttctt agtagaattt aacccggtta actccactc aacttttaag
75721 atgataagaa agttaccagt acaagaacaa aagcctaact tattgaaaga tagtttattt
75781 gtttatcctg aaactagcta ttctaatatt aaaacagata actgggatac gcctccattt
75841 tgggggatatt cttctaatag tggtcgttca ggagttagat ttagaggaga gaatacagta
75901 cagatagatg atgggtctga tacgtaccct tcagtagttt ctaataggtt taaaatgggt
75961 aaagaacttt ctgtaggtga tactgtaacg gtatcagtat atgctaaaat taatgaccct
76021 gctttactta aagataactt agttacttt gaattagcag gatacgatac tgtagatgat
76081 actagtaaaa atccttatac aggaggacgt agagaaataa cagcaagtga gataacaact
76141 gagtggaaaa aatactcttt cacattcact atacctgaaa atacaatcgg agcatcaggc
76201 gttaaagtta attacgtatc tttactacta agaatgaatt gttcatctag taaaggtaat
76261 ggtgctgtag tatactatgc cttacctaaa ttagaaaaat catctaaagt tacaccattt
76321 attacacatg aaaatgatgt tcgtaaatat gatgagattt ggtctaattg gcaagaagtt
76381 attagtaaag atgaattaaa aggtcactcc cctgtagata ttgaatataa tgattattt
76441 aaatatcagt ggtggaaatc tgaagttaat gaaaagagtt taaaagattt agctatgaca
76501 gtacctcaag gatatccatac attttattgt caaggctcta ttgccgggac gcctaaggga
76561 cgttctatta gaggaaccat tcaggtagat tatgacaaag gtgacccata tagagctaat
76621 aagtttgtta aattattgtt tactgacaca gagggtattc cttacacatt atatatggt
76681 ggttataacc agggttggaa acccttaaag caatcagaaa cttctacttt actatggaaa
76741 ggtactttag attttgggtc tacggaagct gttaacttaa atgactcatt agataattac
76801 gatttaattg aggtaactta ttggactcgt tcagcaggac atttttctac aaaaagatta
76861 gatataaaaa atacatcaaa ttactgtatt attagagatt ttaatatttc aaatgatagt
76921 acaggttcta gtgtagactt ttttgaaggg tattgcactt ttcctactag aacatcagta
76981 caacctggta tggtaaaatc tataacttta gacgggtcta caaatacaaac aaaagtagca
```

Figure 18 (contd.)

77041 tcatggaatg aaaaggaacg tataaaggta tacaatatta tgggaattaa tagaggataa
77101 agaaaggtgg aataaaaaaa ctatggctgt taaatatgat ataggtaata atgagatagt
77161 attacattta agagaaggta aatatataac agggtttaca acagtaggag ggtatgataa
77221 ggagttagga caagtaaaag ttaatagaga aatcttacct gcttacttct ttgataattt
77281 tgcctatgaa agatatttgt attatagtaa acctgaagag gttatagaaa ataaaaacta
77341 tgtaccacca caaatcaatg atgatgatga ggaatcccaa caaattactg tacctaaaga
77401 acaatatgat agtttaaaag aagaactaga gcttatgaga aaacaacaag aagctatgat
77461 ggaaatgctt caaaagctct taggtcaaaa ggggtaatta taaatggcat taaatttac

Figure 18 (contd.)

77521 tacaataacg gaaaacaatg ttattagaga cctgactact caggtcaata acattggaga
77581 agaattaaca aaagaaagaa atatatttga cattaccgat gatttagttt ataattttaa
77641 taaatcacag aaaattaaac taactgatga taaaggatta actaaatctt atggaaacat
77701 aacagccctt agagatataa aagaacctgg ttattactat ataggtgcta gaacattagc
77761 aacattatta gatagacctg atatggaatc tcttgatgtt gttttacatg tagtacctct
77821 tgatacttct agtaaggtag ttcaacattt atatacacta tctactaaca ataaccaaat
77881 taaaatgtta tatagatttg tctcaggaaa ctctagttca gaatggcaat ttattcaagg
77941 attacctagt aataaaaatg ctgttatatc aggaactaat attttagata tagcttcacc
78001 aggtgtttac tttgttatgg gaatgacagg aggaatgcct agtggagtaa gctccggatt
78061 tttagactta agtgtagatg ctaatgataa tagattagct agactaactg atgctgaaac
78121 cggtaaagaa tatactagca ttaagaaacc tacaggaaca tacacagcct ggaaaaaaga
78181 atttgagcca aaagatatgg agaaatatct actaagtagt attagagacg atggtagtgc
78241 atcattccca ctcctagttt atactagtga tagtaaaaca tttcaacaag ctattataga
78301 ccatatagat agaacaggtc aaacaacctt tactttctat gttcaaggcg gtgtatccgg
78361 ttcccctatg tcgaatagtt gtcgagggtt attcatgtca gacacaccta atacttctag
78421 tttacatggt gtttacaatg ctataggtac agatggtaga aatgtaacag gttcagtggt
78481 aggtagtaat tggacttcac caaaaacatc cccttctcat aaagaattat ggacaggagc
78541 acaatcattc ttatctacag gaactactaa gaatttatca gatgatatta gtaactactc
78601 ttatgtagaa gtttatacta cacataagac aacagagaag actaaaggta atgacaatac
78661 aggaactata tgtcataagt tttatttaga tggtagtgga acttacgttt gttcaggtac
78721 atttgtttcc ggggatagaa ccgatacaaa accccctatc acggagtttt atagagtagg
78781 tgtatctttt aaaggttcta catggactct tgtagatagt gcagtacaaa atagtaaaac
78841 tcaatacgtt acaagaatta taggtattaa tatgccatag actaggagaa atttcctagt
78901 ctttttttt cttgacttga aaaggattct gtggtatact ataactcgtg taaggatata
78961 aggagattaa aatgagatta agaattaaga acttatatac ctatgtagaa tttgaggagg
79021 atgataaata cttaaaagat atattttaa agagagtcca tacgactata ggagcaagac
79081 aagaaggatt tcagtacagc cctgcgtaca aaagaggtag ttgggatggt tatgtagatt
79141 tttatgttta tgaggaagat aaattccccca ctggactttt atttaaaatt gagttattat
79201 taggtgagct acaatcaagg tataatttcc agtttgaaac aattgatgag cgtgatgaaa
79261 gttccttatc tgaagaagat attgatgatg agataacatt gcttgataat aatgtcggtc
79321 aaaattacctt aagagattac caatatgaag cagtgtacaa tagcttaaca tttacaatg
79381 gtattgctca cttagctact aatggtggta aaactgaggt tgctagtggt attatagacc
79441 aattattacc tcaattagaa aaaggtgaga gagtagcatt cttcacaggc tctacggaga
79501 tattccatca gtctgcagat aggctccaag agcgtttaaa tattcctatt ggtaaagtag
79561 gtgcaggtaa gtttgatgtt aagcaggtta cagttgtaat gatacctact ttaaatgcaa
79621 accttaaaga cccaacacaa gggtaaagg ttacgcctaa acaaaatatt agtaaaaaga
79681 ttgctcaaga gatattacct aaatttgaag gtggaacaaa tcaaaagaaa ttactaaaag
79741 tattacttga taacacaaca cctaaaacaa aagtagaaca aaatgtatta agtgccttag
79801 agataattta ccaaaatagt aagacagatg cagaagtttt attaaactta agaaatcata
79861 atgcacattt tcaaaaaatt gttagagaaa agaacgaaaa gaaatatgat aaatatcaag
79921 atatgagaga tttttagac tcagttacag ttatgatagt tgatgaggca caccattcta
79981 aatctgattc ttggtacaat aatttaatga catgtgaaaa agctttatat cgaattgcat
80041 taacagggtc tatagataaa aaagatgaat tactttggat gagattcag gcgctattcg
80101 gtaatgttat tgcacgaact actaataagt tttaattga tgaaggtcat tctgctagac
80161 caacaataaa tattatacct gtagctaatc ctaatgacat agatagaatt gatgattata
80221 gggaagctta cgataaaggt ataacaaata atgattttag gaataaactt attgcaaaac
80281 taacagaaaa gtggtataat caagataaag gtacattgat tattgtaaac ttcattgaac
80341 atggagacac aatatcagaa atgttaaatg atttagatgt agagcattac ttcttacatg

```
80401 gagaaataga ctctgaaact aggagagaaa aattaaacga tatgagaagt ggtaagctta
80461 aagtaatgat agctacatca cttattgatg agggtgtaga tatatcaggt attaatgcac
80521 taatattagg tgcaggaggt aagtcattaa gacaaacatt gcaacgtatt ggtcgtgctt
80581 tacgtaagaa aaaagacgat aatacaacac aaatatttga ttttaatgat atgacaaata
80641 gatttttata tactcatgct aatgagcgta ggaaaattta tgaagaggaa gatttttgaaa
80701 taaaagactt aggaaaatag gagggtaaga gatggcaaca aaaacacaaa gaaagctata
80761 ccaatatcta gaggaaaatg ctacagaaaa taaatttcat atttctacta agaaagagct
80821 agcagattct ctaggtgttt ccatctctgc tttatccaat aaccttaaaa agttagaaga
80881 agaaaataaa gtcgttactg tttctaaaag aggaaaaaac ggcggggtaa taataacttt
80941 agttagagag tatgacacag aagaattgaa agaattcaat aattctacag ataatatat
81001 tacttccgat ttacagtatg ctaaggcatt aagagaaaag cacttccctt cttatagata
81061 tgagagaaaa gaacaacgta gacgtactaa gatagaaatg gcacaataca atgccattaa
81121 ggatgagaag agaagaatta tagcagatat gaatttctat tcagaaggtc ttccttatcc
81181 ttctaaagat attttaata tgtcctatga cccggaaggg ttttataaag cgtacatctt
81241 atgtaagtta tacgaccaat atgctatttc tcatatggat gctaaacata caagtcatct
81301 taaagcaatg agtaaggcaa caactaaaga tgaatacgac taccatcaac atatgtctga
81361 atactataga aataaaatga ttcaaaattt acctagaaat agcgttagtg ataatttctt
81421 tggtagtaaa atgttaata cttttataa ttttattta aaaataaaag ataaaaatat
81481 taatgtattt aagtatatgc aaaatgtatt taaaaatgta acattttatt acgagaacgg
81541 tatgcaacct aatccaatac ctctctcctaa cttctttagc tcagataagt attttaaaaa
81601 ctataataat tatattaaag gaataaaaaa aggtgttaac agtactaata gacacctagg
81661 tgatacagac agcatcatta attcatcaga ctatgtgaaa aaccctgctg tattacatct
81721 acaccaacta tatactacag gattaaaattc tacttttacat gatattgata ctatgtttga
81781 acaagccttta gaccttgaaa atgcctccta tggattattt ggagatatga aacatattat
81841 tttactacag tataattcta tgattgaaga agaaattaag aatttaccta gagaagaaaa
81901 ggatattatt aataaatatg taaaacaatg cataattaat gattattcac caacaagtat
81961 ttcaccttct gcaaggttat caatgtttac tatgcagaaa gagcatatag tttacaataa
82021 gcagttaaat aaaggaatca agagagagga tttattacca ttaagtctag gaggtatagt
82081 gaataaagat ttattgagtg gtatggatat acaaaactta gaacagaatg gtaatgaata
82141 cctatatatg agacaacata cttcaactta ttatatatta agaatgtttg gtgactattt
82201 agggtatgag gtaaactlaa gagaagtaaa atatattgta gagaatatat atttaattga
82261 taaaatacca ttgacaaaag agggtatgtt ggattataat aaacttatac atttagtaga
82321 ggaagaggtt aataactatg agtaagaaga taaaggagct tatccttcat aaatcaatga
82381 aggatatca ttttgcaaga gaagtattag ataacttacc taagaatcta ttttcagcag
82441 agtctgagga catgggttac ttatttacag ctataaagag aacagcacat atttccgata
82501 agatgtcaaa tgaagcatta gcaattaaag tagaacagct tatgggtaat aataaggaag
82561 atgaagagaa agtaaccaag acattaactt actagaaga tttatataaa gtagacgtta
82621 atgaaaaaga tgaatctgtt aattatgaaa tagagaagta tattaaaaca gaaatgtcaa
82681 aagaagtttt agttaaattt attgcagaaa ataaacaaga agactctgat aatctacatg
82741 aacttgtaga caaactaaag caaatagaag taagtgacat ctcaggaggt aatggggagt
82801 ttattgactt cttcgaagat acagaaaaga aacaagaact attgagtaat ttagctacaa
82861 ataaattctc tactggattt acttctattg acaaccatat tgaaggtggt atagcaagag
82921 gagaggttgg attaatcata gctcctaccg gtagaggtaa atcattaatg gcttcaaact
82981 tagctaagaa ttatgttaaa agtggattaa gtgttttata tattgcctta gaggaaaaaa
83041 tggatagaat ggttttgcgt gctgagcaac aaatggcagg agcagaaaag agtcaaattg
83101 taaatcagga tatgtcttta aataataaag tttatgatgc aatacaaaat cattatcaga
83161 agaatagaaa gttattaggt gactttata tttctaaaca tatgccaggt gaagttacac
83221 caaaccaatt agaacaaatt attgtcaata caacaattaa gaaggataaa aatattgatg
83281 ttgttattat tgactatcct cacttaatga gaaatcctta tgctaaatat cattcagaat
83341 cagatgcagg agggaaattg tttgaagata ttcgtagatt atcacagcaa tatggatttg
83401 ttttgttggac gttagctcaa actaaccgtg gtgcttatgg ttcagatgtt attacaagtg
83461 agcatgtaga aggttctcgt aagattgtca atgctgttga ggtgtcttta gcagtaaacc
83521 aaaaagatga agaattcaag agcgttttct taagattgta tttagataaa attcgtaata
83581 gctctaacac aggagaacga tttgttaatc ttaaagtaga accaactaag atgattgtaa
83641 gagatgaaac acctgaagaa aaacaagagc atatacaatt gctatcagat aatggaaaag
83701 aagacacaag taaatttcaa aataaagata ataaaataga agctataaat aacacattcg
```

Figure 18 (contd.)

```
83761 gaggattacc gggagtttaa ttttttaaaa tataccactt gacattttat atgttaggtg
83821 gtataattat tttataaaga ataaaggaga gattaataat gaaatttgta ttctttacag
83881 atagccactt tcacttattt actaactatg ctaaacctga tgagcagtat gtgaatgata
83941 gatttagaga acagatacaa gctttacaga aaatgtttga tattgcaaga gaagaggatg
84001 caacagttat atttggtggg gatttattcc acaaacgtaa cgcagtagat actagagtat
84061 ataataaggt atttgaaaca ttccaactta atagagatat agaagtacta atgttaagag
84121 gtaatcatga ttcagttaca aatagtttat atacagaatc tagtatagaa ccttttcggtt
84181 acttacctaa tgtagaggtt tgtaaaaacc ttgatacttt agggttttta ggagaagaac
84241 aggatattaa tattgttatg gctccttatg gagacgagac tgaagaaatt aaagagttta
84301 ttaaaaataa atatgtagaa gatagagtaa atatcttagt aggtcattta ggtgtagaag
84361 gctctttgac tggaaaaggg tctcatagat tagaaggggc atttggatac caggatttat
84421 tacctgataa atatgatttc attttactag gtcattatca ccgtagacaa tatttccaaa
84481 atccgaatca tttttatggt ggtcattaa tgcaacaatc attttctgat gagcaagaag
84541 ctaatggtgt tcatttaata gatacagaaa aaatgactac agaattcatc ccaatccata
84601 cacgtagatt tattactatt caaggagaag atattcctga gaactttgaa cagctaatcg
84661 aggaagataa ttttattagg gttatcggta cagcaaatca tgctaaggtt ttagaaatgg
84721 atgacagtat gaaagataag aatgttgaag ttcaaattaa aaaagagtat actgtagaga
84781 aacgtattga tagtgatgtg tctgatgacc ctttaacaat tgctagtacc tatgctaaac
84841 aatactcacc tgaatcagaa caagaaatac ttgagtgttt gaaggaggtt ttataatgaa
84901 aaaatataga gaatatctaa ataagacaga tgcagaaaat ttagcagagg attgggagaa
84961 agtaaccgaa gatttatgga aagtgtttaa agatatgaaa cctaaaatta atacattaga
85021 tatcagtaat gtagtaagta aagacttaga taaaagtaaa cctattttac aattccaaga
85081 ttcagatgga gtaatagaga atatttgtaa tgttgaaggt ttagaagatg gtctaagtaa
85141 aatgaaaaag atttttgatg atagtaattt tgaaaagcat tattacaata gagtagtaga
85201 ccatgatgag tattactgga ttgattatgg ctctcatcat tgtttcttta gagttacgaa
85261 aggggataag taatggttgt atttaaacaa gtagaagtta ataatttttt agcaattaaa
85321 gaagctacgc tagagttaga caatagagga ttaattctaa ttgaaggtga gaataaatct
85381 aatgagtcat ttcattcaaa cggctcagga aaatcaactt taatatctgc cattacttac
85441 gctttatatg gtaaaactga aaaaggacta aaagcagatg atgtagtaaa taatattgag
85501 aagaaaaata catctgttaa acttaagttt gatattgggg aagatagtta tttaattgaa
85561 cgttatcgta aagataaaga gaataagaat aaagtaaaat tattcgttaa tgaaaaagag
85621 attacaggtt caacaaatga cgttaccgat aaacaaatac aagatttatt tggtattgag
85681 tttaatactt acgttaatgc catcatgtat ggtcaaggag atatccctat gttctctcaa
85741 gcaacagata aaggtaagaa agaaattctt gaatctatta ctaagacaga cgtatataaa
85801 caagcacaag atgtagcaaa agagaaagtt aaagaagtgg aagaacaaca aaataacata
85861 agacaggaaa tctataaact aggttatcag ttatcgacaa aagatgagta ctttcaaaga
85921 gaatagagc agtacaatca atataaagaa caattggttc agatagaaaa cagtaataag
85981 gaaaaagata gattaagaga acaagaggag aagcaaatag aagctcaaat agagcaacta
86041 gcttcacaga taccaacaat acctgaagat gaatttaagc actcagagga gtataataaa
86101 gcctctcaaa gcctagattt actttctaat aaattaacgg agttaaatca agtttactca
86161 gagtataata ccaaagaaca agtactaaaa tctgaaatag ctacattaag caatagtcta
86221 aatcagttag atacaaatga ccattgtcct gtttgtggct cccctataga taattctcat
86281 aaattaaaag aacaggaaaa tatcaataat cagattgaga ataagaaaca agagattact
86341 agtgtattag aaatgaaaga tacgtataaa gaagctattg ataaagtaaa agataaatca
86401 caagaaatta aagataaaat gtcacaggaa gaccaacaag aacgagagca caataataag
86461 attaacagca taattcaaga ggcttctagg attaaatcag acattagttc attagagaat
86521 aataaaacgt atttaaaagt taaatatcaa catcaatctg ttcaaggatt agagagagaa
86581 gaaccaagta aagaaaaaca tgaggaagat aagaaagaat tacaagaatc tattgacaaa
86641 catgaagaga atatagtaca attagaaact aagaaaggta aatatcagca agctgtagat
86701 gcttttagta ataaaggtat acgttcagta gtgttagact ttattacacc attcttaaat
86761 gaaaaagcaa atgagtacct tcaaacttta tcaggttcag atattgaaat agagttccaa
86821 actcaagtga agaatgctaa aggagaacta aaagataagt ttgatgttat tgttaagaat
86881 agcaagggcg gaggttcgta caatccaat tcagcaggag aacaaaaacg tattgattta
86941 gcaattagtt ttgcaattca ggatttaatt atgagtaaag atgagatatc tacgaatatt
87001 gcactttacg atgagtgtt tgatggatta gatactatcg gttgtgaaaa cgtgattaaa
87061 ttattaaaag atagacttaa tacagtagga acaatatttg taattactca taataccgag
```

Figure 18 (contd.)

```
87121 cttaaaccac tgtttgaaca aacaattaaa atcgtaaaag aaaatggagt atcaaaactg
87181 gaggaaaaat aatgaaatta aagattttag ataaagataa tgcaacactt aatgtgtttc
87241 atcgtaataa ggagcacaaa acaatagata atgtaccaac tgctaactta gttgattggt
87301 accctctaag taatgcttat gagtacaagt taagtagaaa cggggaatac ttagaattaa
87361 aaagattacg ttctacttta ccttcatctt atggtttaga tgataataac caagatatta
87421 ttagagataa taaccataga tgtaaaatag gttattggta caaccctgca gtacgcaaag
87481 ataatttaaa gattatagag aaagctaaac aatatggatt acctattata acagaagaat
87541 atgatgctaa tactgtagag caaggattta gagatattgg agttatattc caaagtctta
87601 aaactattgt tgttactaga tacctagaag gtaaaacaga agaagaatta agaatattta
87661 acatgaaatc agaagagtca caactgaatg aagcacttaa agagagtgat ttttctgtag
87721 atttaactta tagtgactta ggacaaaatt ataatatgtt gttattaagt aaaaaaaatta
87781 gtaaatagta aggaaggata ttatgaggtt tgaagactttt ttaacccaag aattaggaga
87841 accaaaagaa aatactatag gtgagctaag atactgttgt ccgttttgtg gagaaaaaag
87901 ttataagttc tatgttaagc aagccctaga ctctagtaat ggtcagtatc attgtaaaaa
87961 atgtgatgaa tcaggtaacc ctattacatt tatgaagact tattataaca ttacaggtaa
88021 acaagctttt gatttattag agtctaagaa tatagatata gagagagccc ctttacttac
88081 gaccaataat aaggatttga cagaatcaga gaaacttata ttaatgctta gaggtgtgca
88141 ccaagataaa ggaaatacta gtattaaacc tcctagatta cctgaagggt ataaattatt
88201 aaaagataac ttaaataata aagagattat acccttttta aaatacttaa aaggtagagg
88261 tataacttta gaacaaatca ttaataacaa tataggttat gttattaatg ggagcttta
88321 taaagttgac ggggaatcca aagtatcatt aaggaatagt attatatttt ttacttatga
88381 taatgatgga aactaccagt actggaatac aagaagtata gagaagaacc cttatattaa
88441 atctattaat gctcctgcta aacaagatga agtagggaga aaagatgtca tatttaattt
88501 gaatatagca agaaagaaaa agtctcttagt tataactgag ggtgtatttg atgcttaac
88561 cttccatgag tatggagtag caacattagg taaacaagta accgagaatc aaataaaaaa
88621 aataattgat tatgttagta tagatacatc aatatatatt atgttagaca ctgatgcact
88681 agataataat atagacttag cttataagtt aaaaacacat tttaataaag tttactttgt
88741 acctcatggt gatgaagatg caaatgatat ggggacaagg aaagcctttg agttattaaa
88801 acagaaccgg gtgttagtaa cacctgaaag tatacagagt tacaaaatac aacaaaaact
88861 taaactttag gcttgaccctt agagaagttt tatgttatac tagtaattaa gtaattaata
88921 aaggagaaaa aaaataatgt caaataataa aaaagatattt ttagaatttg tagatgaata
88981 cattacagct ttaagagttg gtaatgagca acgacaacat caattagaag aaatgggtaa
89041 agaagaaaca gcaacattaa cagatgtagc taaagctatt actaaccta tgttaggtgt
89101 taatgagcag atgacagact tagaatataa taatgagtta aacttaaata ttttaattga
89161 cgctttatat aaagcagagc ttattaatga agatgtatta gactacattc aagaatcaat
89221 tgataaatca caagaagaac ctaaaaatga agaagaaaaa ggagaacaag aataatggaa
89281 aaaaatatta gcacacacac aaaaggtatt agtcaagcag acatggagaa atggattgaa
89341 gctgcagtac aaggaactgt tgatggtaaa caagttgatg agaaaacagc taaacaatta
89401 gatagaattg gttcacgtag tgtttcttta gaagaagcaa ctcgtattgc taaagttctt
89461 aatgctgtaa cagctcaaga ggttacagga gactttaatg atgcatttaa tgcaattgac
89521 ttaatgatga ttatcatgga agatgagtta ggagtaactc aagaaaaagt agggaaagct
89581 aaagataaac taaatgaaaa acgagaagct tacctaaaag agaaacaaga agaattacgt
89641 caaaaacaac aagaagaggc acagaaaaaa actgaatctg acagcaatga aaaagtaatt
89701 cagttgaaga aaaatgacga acagtaagaa aaaagggggat acattcgaac gtaaaatagc
89761 taaagaatta acttcttggt ggggataccaa attcaatagg tctcctcaat caggtggtgc
89821 ttcatggggt aaagataata atgctgtcgg agatatagta gtacctcagg aagctaattt
89881 tcctttagta gtagaatgta aacatagaga agaatggact atagataatg ttcttctaaa
89941 caacagagag ccacatacat ggtgggagca agtcattaat gatagtagca aggtgaataa
90001 gacacctgtc ttaatattta ctagaaaatag agctcagagt tatgttgctt taccttatga
90061 tgaaaaagta tatgaagatt taagaaataa tgaataccct gtcatgagaa cagatttat
90121 tattgataat attagaaaag ataaatttt ttatgatgtc cttataacta ccatgaatgg
90181 gttgacctca tttacaccctt cttatattat atctttgctac gacaaaaaag atataaaacc
90241 atacaagaag gtcgagtcta atttatctga ggtaagtaag catgaagatg aattgattaa
90301 tgaccttctt agtgatatat aaggaaggta agataagtat gacaagtaaa gaaagaccat
90361 taatcgtata tttttcaggt acaggacaaa cagaaagatt agtaaacaaa attaatatta
90421 ataattcatt tgaaacattt agggttaaga gtggaaaaga aaagtaaat aaaccttta
```

```
90481 tactaataac acctacttat aagaaaggtg caatacctaa acaaatagaa agattcctag
90541 aaattaatgg gagccctaaa gaagttattg gtacaggaaa taaacaatgg ggctctaatt
90601 tctgtggagc aagtaaaaag atttcagaga tgtttaagat tcctttaatt gctaaagtag
90661 agcaatcagg acactttaac gagatacaac caatattaga acactttagt aataaatata
90721 aagtagcgta aaggatgaga gatatatggc aacatatgga aaatggattg agttaaataa
90781 tgaaataact caattagatg acaatggaaa aaataaactc tataaagacc aagaagcttt
90841 agatgagtat ttaaaatata ttgaagacaa tacaagaaag tttaatagtg aagtagaaag
90901 aattagagta ttgacaaaag aaggaacata tgataaaata tttgacaacg ttcctgacac
90961 tattattgat gaaatgacta agttagctta cagtttaat tttaaattcc ctagtttcat
91021 ggcagggcaa aagttttatg aatcttacgc atcaaaacag tatgatgaaa acaaaaaacc
91081 tatttttgtt gaagactatg aacaacataa tgttcgagta gctttatatt tatttcaaaa
91141 tgactatgta aaggctagag aattactagt acaacttatg gagcaaacat tccaaccatc
91201 tacacctacg tataacaact caggacaagc taatagaggt gaactaagct catgttatct
91261 atttgtagta gatgattcaa ttgagtcttt aaactttgtt gaagatagtg tagctaatgc
91321 tagttctaat ggtggtggag ttgcaattga tttaactaga attagaccta aaggagctcc
91381 agtacgtaat agacctaatt caagtaaagg tgttattgct tttgctaaag ctattgaaca
91441 taaagttagt attatgacc agggtggtgt aagacagggt agtggtgctg tttacctaaa
91501 tatattccac aatgatatct tggatttatt aagctctaag aaaatcaatg ccagtgagtc
91561 tgttagacta gataaattat ctattggtgt tacaatccct aacaaattta tggagttagt
91621 taaagaaggt aaacctttct atactttga tacttacgac attaataaaa tgtacggtaa
91681 gtatttagat gagctaaaca ttgatgaatg gtatgataag ttactaaata atgatagtat
91741 cggtaaagta aaacatgatg ctagagaagt tatgacagac attgctaaaa cacaattaga
91801 atcagggtac cctatgtat tctatattga taatgctaat gataatcacc cattgaaaaa
91861 cctaggtaaa gttaaaatga gtaacttatg tacagaaatt tcacaattac aagaggtatc
91921 agaaatttat ccgtattctt acagtaatca gaatgttatt aatagagatg ttgtttgcac
91981 attaggttct cttaacttgg ttaatgtagt tgaaaaaggt tattgaatg aatctgtaga
92041 tattggtaca agagcattaa caaaagttac tgatattatg gatttacctt acttacctag
92101 tgttcaaaaa gcaaatgatg atattagagc tatcggttta ggttcaatga atttacatgg
92161 actttagct aagaatatga ttagttatgg ttctagagaa gcattagacc tagtaaacag
92221 tttatatagt gctattaact tccaatctat taagacatct atgttaatgg ctaaagaaac
92281 aggaaaacca tttaaaggct ttgagaagtc cgattacgct acaggtgaat acttttgtaag
92341 atacattaga gaatccaatc aacctaagac agataaagct aagaaagtct tagataaggt
92401 ttatattcca acacaagatg attgggatga attagctaaa gcagtgaaag tacatggttt
92461 gtataatggt taccgaaaag cagaagcacc tactcaatct atatcttatg tacagaatgc
92521 tacaagttct attatgccag tacctagtgc tatagagaat agacaatatg gagatatgga
92581 gacatattac ccaatgcctt acctaagtcc tataactcag ttcttctacg aaggagaaac
92641 agcttataag attgacaata aacgtattat taatacaagc gcagttgttc agaaacatac
92701 agaccaagca gtgtctacaa tactttatgt agagtcagaa atacctacta ataactagt
92761 atcattatac tattatgctt gggaacaagg attaaatca ttatactata cacgttcacg
92821 taaactttct gttattgaat gtgaaacatg ttcggtttag aaaggaaata gatatggata
92881 ttacacaaaa agtaaaacaa cataataaaa atgctgtatt aaaagcaaca aactggaata
92941 ttgaagatga cgggatgtct gatattttat gggagcaagg aatctcccaa ttttggactc
93001 ctgaagagtt tgatgtatca agagatttaa gttcttggaa tagtttaact gaaagtgaaa
93061 agaacactta taagaaagtc cttgcagggc tcagggct cgatacaaag caaggaggag
93121 aaggtatgaa cttagtatcc taccacgaac caagacctaa ataccaagct gtatttgcgt
93181 ttatgggtgg tatggaagag atacatgcta aatcgtatag tcatatcttt acaacattac
93241 taagtaataa agaaacaagt tatttattag atacttgggt agaagaaaac gacttttaa
93301 aagtaaaagc tcagtttatc ggatattact acgaccaact attaaaacct aatcctacta
93361 tatttgatag atacatggct aaagtagcta gtgcctttt agaaagtgca ttattctact
93421 caggattta ttatccttta cttcttgcag gaagaggtca gatgacacaa tcaggagcta
93481 ttatttataa aattactcaa gatgaagctt accatggttc ggcagtagga ttaacagctc
93541 aatatgatta taatcttcta acagaagaag agaaaaaaaca agcagataaa gaaacttatg
93601 aattattaga tattctttac actaatgaag tagcgtatac acatagtcta tatgacccac
93661 tagaattaag tgaagacgta attaactatg ttcagtataa tttaaataga gctcttcaaa
93721 accttggaag agaggactat tttaatcctg aaccttataa ccctattgta gaaatcaaa
93781 ctaatgtaga cagattacga aatgttgatt tcttagtgg taaagcagac tatgaaaaat
```

```
93841 ctacaaatat caaagatatt aaagatgaag atttctcatt cttagatagt aaagaataca
93901 gtactgccaa ggaattccta taaaaaggag aaaagatatt atggatagaa aagaagcaat
93961 ggatttacta agtaaagcag aaatattatt taaaaaacat gatgagtttt catgtgtaag
94021 tgatatcaat gaccctatga agttattcag taactctaag gatgctaaag ctgatgatac
94081 gtctaattct tttcagctag agtttatgca tgtatatgacc atgtatactt tatcttatgg
94141 ctcaggacag ctaaaactta ttgatttagc agaaggttat gaagcacaaa aagctacaat
94201 agttaactca tttcccgaaa ttattaaaac attagaaaag gatgattcag aagatggaaa
94261 aaatgaatag tttagtagat ttaaatacag caattagaca aaagaaagat gttattgtca
94321 tgattacaca agataattgt ggtaagtgtg agattttaaa aagtgtaatc cctatgtttc
94381 aagagtcagg tgacattaaa aaacctatct taacattaaa tctagatgct gaagatgtag
94441 atagagaaaa agctgttaag ttattcgata tcatgagtac accagtatta attgggtata
94501 aagatggtca gttagttaaa aagtatgaag accaagttac acctatgcaa ttacaagaat
94561 tagagtcact ttaatttgga atttcctact atctgtgcta tactataata gtacaaggta
94621 gtaggatttt ttaatggaag gaagatgaca tatcgcaaag aataaaacat taacgatata
94681 taatagtgat agatatttta atatacacac aaaagataaa gataaaatta atgaggctat
94741 taaagtaaca cacggtaatg aagaagaaat tgaaaagaat atggatgaat taatatctaa
94801 gtctagaaga tatatcatga gggatgaaaa gcattacatg ctatttaatg agaagtacaa
94861 taatgatagg cttatagaaa aagtatgtaa acacggtggt aaagttacat actatactga
94921 ttcagtatta ccttactatg ttttaaaaga cttatctagt caccctgact cagaagttgt
94981 ttatcgtatg cgcaacggtt ttactgcaaa agaagtagat aatatagctt tatcattcat
95041 gggtacaaaa gttattattg atatttctgt agtattcct tatgtaaacc cttatgatat
95101 tattagaagt ttacatgata ttaaaacaaa tgtagatgaa gttcatttat catttccacg
95161 aatattaggg gtagatgaaa aacaagaaaa gttttatttc tttgatggtg aagcttatga
95221 tttaaaaccc gaatataaag tcgattttgc agataaaatt agagtatctt tatcagtatg
95281 gaaaatgtat atctatatct taacaagtag tcgtgatttt gaggatgtag acaatgtaat
95341 tacgaaatta aaacaacaac gaaagattaa gatataaggt gattatatga gtacagcaaa
95401 tagaagagat atagcaagaa agatatcaga gaatacaggt tactatatcc aagtgtgaga
95461 ggaatactaa agtgcagaga cagatgctat ttctgacttg ctagaagaag ggtatactaa
95521 agtaaagaat cataaaattta tgcaaataga agttattgaa agaaaaggta aaaagcgtg
95581 ggatggtctg aataaagaat acttccattt acctaataga aaagctataa aattcaaacc
95641 actaaaagaa ctagaagagg ttattgatag acttaatgaa gaagagaaat aattctcttc
95701 ttttttatt gacaaaggttt aaaatatatg gtatagtatt attaagttaa aaaaggagag
95761 gaattaaatg aaagtattaa tcttatttga ccacattaga gaagagcatt tttctgtaag
95821 taaagatggg agtgtgaaat ctaatgtact aaatacacct aacggaaaaa cacttaagaa
95881 attacttgag aagtgttcta acttaaagag agataaaaca aacagagatt atgatattga
95941 ttttctctac aatgcagtac ctacacctat tagaaatgac tacggtaaaa tcattaaata
96001 ccaagatgtt aaacaagcag aagtaaagcc atactatgag agaatgaata atattattat
96061 tgataattct tatgatatgg taattcctgt aggtaaacta ggtgttaaat acctattaaa
96121 tgttacagct attggtaaag taagaggtgt accaagtaaa gtaactattg aaaatggaac
96181 atcttctcat gatgtgtggg tattacctac ttatagcatt gaatatacta atgtaaataa
96241 aaatagtgaa cgtcatgtag tatcagattt acaaacagtt ggtaagtttg tagagcaagg
96301 agaagaggca tttaaaccta aggaagtatc ttacgagttg gtagataaca ttgaaagagt
96361 aagagaaata ttcaataagg aagtaaagaa tgataattat gatgggggtag atattaccgc
96421 atgggactta gagactaact cattaaaaacc tgataaagaa ggaagtaaac ctttagtact
96481 atctctatca tggagaaatg gtcaaggtgt aactataccc ttatacaaat cagactttaa
96541 ctgggaaaac ggtcaagatg atattgatga agtcttagaa ttgcttaaga attggttagc
96601 tagtaaagaa gatattaaag tagcacataa cggtaaatga tttgctgttg taaaatccct
96661 ctcatatcgg gcatagcttt aagtagctga taagagaacc taagtcctgt aataaggata
96721 gtggtaatcc cgagcttaca ttattggtga caatagatgg ggtgtagaga ctgagccgag
96781 gttttgtaga ccaaggtgag acatagtgta tcgacttaat agaggtgta cagtgaaaaa
96841 agattatatg acatcagtta aaaataacaa aaaagtatgt agaagatgca acgaagaatt
96901 agatttatct aactttaaaa catataagaa gaatgataaa acttattatc aaagtatgtg
96961 tataccttgt cggaaggaat ataataagtt agataaaact aaaaaatacta ttaaaaaatg
97021 ttatgagaaa aacggagata aatatagaag acaaagtaat gagtataata cttctgacag
97081 aggtagagag cttaataaaa ataggtctag gaaatacaga gaaaacaatt ctttaaaatc
97141 gaaagctaga agctctgtaa gaaccgcatt aagaaatggt tctctcataa gacctgataa
```

Figure 18 (contd.)

```
97201 gtgttcagag tgtaataaag attgcatacc tgaagctcac catcctgatt atactaaacc
97261 tttagaaata aaatggttat gtaaatcctg tcatgaagat actcatcata aaaaataatc
97321 acactatgta aatgagggac atcaagccca tttaggtaac tacaaacaaa cctaatggta
97381 agggcttatg aaggtatagt ccgttctata tagaaatata taggctaaaa cgaaatatga
97441 tattaagttc ttaatgagta ctgaaaactt taaagatttt gagagtattc aggatactaa
97501 agtaggttgg tacctagctg ttacccaaga agttaaagaa tctttaagat tatctgattt
97561 agcttatgag gttacagatg tcggaggcta tgataaacca ttagaagact ttaaattatg
97621 gtttgttact aagttattaa gattcttctc agataaaatt aaagagatac agaaagaaaa
97681 taaaaagatt gctaagaaag agtatgatgt taaagctcct gaatataaag aatggttaga
97741 gaataaatta aatgaaacag tagtagaact agatgatact gagaaaaaat ttagagttag
97801 tgaattagag aaaaagtata ttcaactagg tctttcaacct gaaattgtaa atatgaattt
97861 agttatggat aatgatgaat tcataaaatat tgcagaacaa tcacctgagt acatggggtt
97921 atctgactac gctaagtctt acacgttaaa tactgcaatt aatttaatta atgagtatag
97981 agatgtaaaa gatgtagtta atgatattga cggaggtaac tttaattatg attggttccc
98041 tattgagtta atgcatccat acgcatcagg agatactgat gtatgtagaa gaattcattg
98101 tgatgtaatt aagaaactta aagaacaaga tagacctaag tcaatgcatt tattagaagt
98161 taattaccca agacttacta agtctttagc tagaattgaa tcaatggtt tatattgtga
98221 cttagattat atgaaagaaa atgatgagtc atacgagtct gagatggcta agaaccatgc
98281 tacaatgaga gagcactggg ctgttaaaga atttgaagaa taccaataca atctttacca
98341 aatggcgtta gaagaacatg agaaaaagcc aaaagataga gataaagata tccatcagta
98401 cagagataaa tttaaagatg gtaaatggat gttttcccca agtccggag accataaagg
98461 tagagtaatt tatgatattc taggaattca attccttat gataaagaat atgtcaagga
98521 aaaaccattt aatgctaatg ttaaagaagc agaccttact tggcaggact ataaaacaga
98581 caagaaagct attggttatg cgttagataa tttagaatta aaagatgatg ttaaagagct
98641 tcttgaatta cttaaatatc atgctagtat gcagacaaaa cgtaattcat ttactaagaa
98701 attacttaat atgattaata aacaaaaacg aacattacat ggttcttttt ctgagacagg
98761 cacagagaca tcaagactaa gtagtagtaa cccttaaatt ggggttgtaa aactttgtta
98821 actgcgggaa gagactcgtt aggtcttaac tactaactta taatggaaac atatataagg
98881 gcaaacagta acgtgtttga tatagtaaaa aggttaagaa tagagagaat ccgcatccaa
98941 gaccctgaaa gtatataaaa gtatgggtaa ggttcaacga ctaggtgttg agacaataca
99001 atcaatacac acccacgaaa gcaaaggtat tatttctgtg gtagggaata ataaggagag
99061 ttatatgaaa gagatttgga agaaagtagt aggatttgaa aactacgagg taagtaataa
99121 aggaaaagta aggaatataa aaactaacta tattttaaag ccgtggataa taaattccgg
99181 atatgagcaa gtatctatag gtattgctaa tgtattagta catagattag tggctatgac
99241 attatacct accgacagct atagtatagt taaccatatt gataataata aattaaataa
99301 ctgtgttgaa aatttagaat gggtaagtta caaaggtaat agtgctcacg ctaataagca
99361 aggaagattg aatacttata gtgcaagaga aaaacttagt tctgtatcta agaaagccat
99421 ttatcaaaaa gatatggaag gtaacatcat taagttatgg gattcaccaa gtgaagctga
99481 aaaagaatct aatgggtact ttaaaagtac taagattagt tccgttgctc acggtaaacg
99541 taagcatcat agaagtttata cttgggaata cgtatataag gattcaaaga gaagtttaaa
99601 taagtctatt aatatgtatg atttaaataa taatttatta tatgaagatt tgacaatgaa
99661 taaaattatg ggtatactag aaatgaataa tcataaaaca ttaagagata aactaagaaa
99721 tacagatgac tttgttgaat acagaggata taaatttaaa aataataatt aaaacctacc
99781 acagaaatga tatatgatat agtctactca atagtgagag ctattgtgtt acctaaacag
99841 taacagattg taaactaaaa agcttacaaa ttatagaatt tacaaaactt acctgcacac
99901 acatcagatg taaataagtt tgattacaaa catccaatta aacgttcatt tgtttctaga
99961 tttgaaaatg gagtactgct agggtccgac tatagcgccc tagagatgcg tattatcgga
100021 ttatttacta aagaccctga tatgctacaa tcattcttaa atggggaaga tatccataag
100081 gctactgcaa gtattgttta caataaacca gtagaagaag taactaaaga agaacgacaa
100141 gcaactaaag cagttaactt cggattagcc tttggtgaat cacccttctc atttgcaggt
100201 aaaaataata tggaagtaag tgaagcagaa gaaatatttg aaaagtattt ccaaacaaaa
100261 ccaagtgtaa aaacttctat tgacaatgta catgagtttg tgcaacaata tggttatgtt
100321 gatacaatgc acggacatag aagatttatc cgttcagccc aatcaacaga taaaagata
100381 aaaaatgaag gtctaagaca gtcatttaac actatcatcc aaggttcagg tagtttctta
100441 acaaacatgt ctttaactta cttagatgat tttattcaat ctcgtaattt aaaatcaaaa
100501 gttattgcca cagtacatga tagtatctta attgattgtc ctcctgaaga agctaaaatt
```

```
100561 atggctaaag tgacaattca tattatggaa aacttaccat ttgatttctt aaaagcagaa
100621 attgatggaa aagaagtaca atatcctatt gaagccgata tggaaattgg gttaaactat
100681 aatgatatgg ttgaatatga tgaggaagaa atagatacat ttaattctta ccaaggttat
100741 attaagtata tgatgaattt acagacctta gaagattata aagagtcagg taaactaaca
100801 gatgaacaat ttgaaaaggc tactaatgtt gttaaaagtg aaaaacatat ttatcaagaa
100861 atttaataaa agtattgaca atatagttaa cttatgttat actatataag taataaatat
100921 aaggaggaaa aagagtgaat acaggggaga ttagatttaa tcgttctatg gatgaatgga
100981 ttataacaag catgtaccag gatgagctag gtgggatgaa tattgttgtt acattctata
101041 atagagaaga aaataaacat ggttctacag ttttaccaac agagtcatct actggagaag
101101 taacagagga attggcaagt cttgaagaag aatatccttt agctttacct ttaagtagta
101161 tctcagttaa tatttaaaag gaggaactga taaatggaaa tacacattga ttccctagat
101221 tttacaaact ttactattaa agatagaaat gggaactcac aagagtttga tattacagat
101281 gagttaagaa ttacagagta tacaatacaa gaggattta tgcaacaatc agctaaatat
101341 gcttttttggg cttctatatt agagaaggta agagcatatt ctgaaatgga acaaagaaac
101401 ctagaaacaa ttggtagtaa gctaaaccttt acaattagac aagagtacga acaacaaggt
101461 aaaaagccta ctaaagatat gattgaatct agtgtttata ttcacgattc ttatcaacaa
101521 caacttaaag ttgttgaggc ttggaattat aaagttaaac aacttcaata tgttgtaaaa
101581 gcttttgaga caagaagaga tatgatgatt caattaggtg cagaattacg acaaacaaat
101641 aaaaatggtg gaattactaa tccatttca cattaaaaaa taagtaaag aatataattg
101701 acaatataa aaaactatgt tataataaat aagtaaatta attaaaagga gaaaagataa
101761 ttatggattt caatcaattt attaacaatg aggcaagcaa attagaaagc aataacagtt
101821 cttttaacaa taatgtagag agctacaaac ctaaaaaccc tgtactacgt ttaggtaata
101881 ttaaagatgc aaacggaaat aaggttgtta aagaaaatgc ttttgtacga gtattacctc
101941 ctgcacaagg aacaaatgtt ttctttaaag aatttagaac aacaggtatt aactatcta
102001 agaaagatgg ttctcaggga ttcacagggt taacattacc tgcagaagag ggttcatctg
102061 tccttgaccc atacattcag gattggaataa caaatggtgt tcagttcagt agattcccta
102121 ataaccagg agtacgctat tacattcatg ttattgaata ctttaataac aatggtcaaa
102181 ttcaaccaaa aacggatgct caaggaaatg taatgattca acctatggaa ttatctaata
102241 caggatataa agaattatta gctaacttaa aagacactat gttaaaacca tcacctaatg
102301 cacctcatag ctttatctca gcaactgaag cattcctagt taatattgtt aaagctaaga
102361 aaggtgaaat gtcatggaaa gtaagtgtt atcctaatgc ccctttaggt gcgttacctc
102421 aaggttgga acaacaatta tctgacttag accaattagc aaaaccaaca gaagaacaaa
102481 atcctaattt tgttaacttc ttaatcaata acgttaataa cacagagtta agtcatgata
102541 acttaaatt taaccgtgaa acaaatgtct taggtgaaga accttcagag cctaaacaag
102601 cacccacaca acaagatgta gatagtcaaa tgccaagtaa tatgggagga caacctaatc
102661 agcctcagca aggtcaagta ggtcagtatg cacaacaagg tcaaagtaat ggtcaaggac
102721 agcagttaca aggtacacaa caacctatca ataacactca atttggtcaa ggaactcctt
102781 caggacaaca accaagtaac acaggttctg ttgattggga taacttagcg caacaacaat
102841 cacaacctga ttcaaaccca ttcaatgatt ttgatgttag cagtgttgat gattcacagg
102901 tacctttga gacacaacct caaaatacac aacaagcacc tgaaccacaa caaactacac
102961 aagagcctcc aaaacaaaaa caaacgcaaa gtattgacga tgtattaggt ggtctagact
103021 tagataacct ataagatata gagtgcctta gagcactctt ttatttgaga tataattact
103081 aggaggatat taaatggcaa gagcaaaaaa aggtaaagaa gtcgatttaa cagatttaaa
103141 tacaattgat ttaggtaaag aattaggatt aacattgcta tcagatacaa acagagcaga
103201 tattaaaaac gttataccta caatggttcc tcagtatgac tatatttttag gtggaggtat
103261 tccattaggt cggttaacag aagtttacgg tttaactggc agtggtaaat ctactttgc
103321 agttcactta tctcgaattg caacacaatt aggtgttatc actatttgga ttgatattga
103381 aggaacagca gataacaatc gtatggagca acttggtgta gatgtttcaa aactattctc
103441 tattcaatca ggagaaggta gacttaaaaa tacagtagaa ttatctgtag agcaagtagg
103501 taaagaatta gagtactgga ttgacactt caatgaaaag attccgggag taccctattgt
103561 attttattgg gactcattag gggctacaag aactcagaaa gagattgatg gcggtattga
103621 tgagaagcaa atgggtctta aggcatcagc tacccaaaaa gtaattaatg cagtaacacc
103681 taaactaaat gatacaaaca cagggttaat tgttattaac caagcccgtg atgatatgaa
103741 tgcaggtatg tatggtgacc ctattaaatc tacaggtggt agagcttttg aacatagtgc
103801 tagtttacgt attaaggttc ataaagcatc tcagttaaaa cagaaaagtg agttaactgg
103861 taaagatgaa taccatggtc acattatgcg tattgaaact aagaaatcta aactatcacg
```

Figure 18 (contd.)

```
103921 accagggcaa aaagctgaag cagacttact atctgattat atggtaggta aagaagatga
103981 ccctatctta ttaaatggta tcgacttaga acatactgta tataaagaag cagttgaaag
104041 aggtttaatt accaaaggag catggagaaa ctatgttaca ttgaatggtg aagaaattaa
104101 acttagagat gctgaatggg ttcctgtact taaagataat aaagagttat atctagaatt
104161 gtttagtaga gtttatggag aacacttccc taatggttac tcaccattac ttaataacaa
104221 agtaatcgta actcaattag aagagtatca agctcttgaa aactactata aagaatgggc
104281 tacagataat aaacaagagg aacaagagga agaactaaaa ggagaatctc aagaaaagga
104341 ttctgaataa tagatggata atttaataga taaaaacatg aatcaggtaa aagaatcttt
104401 ggggaatgca aattcctcag atgttcttcc tttaccttat aaagatatag caaagaaatt
104461 tgaagaagta aaagaaaaag gtgaatcaat tatcattgaa gaaggtggat tccttatac
104521 agattctaca gtgatgtata tagaacatgt aacagataga tgggcaggag gatattcctt
104581 aattagacat gaaggtgaag aagttaaagt acctaagact atccatttct ctgatatata
104641 tgttaaagat aaatcacaca agtaagaat aatcttcgag ggggctaatc cttatgaaga
104701 aagctaataa tggtaataga tatgtaatag atatagatgg tatacctgtt gattttgaaa
104761 gggatttaga tagtttactt aataggtata aaaaccttag atggtcgtta tatcataggt
104821 acgcagggat tttatctaat gattttgaaa gacaagaact aagagaatat attgatgagc
104881 aatttattaa attagttaaa gaatataata ttagaagtaa agtggatttt cctggatata
104941 ttaaagctaa actaactta agagttcaaa atagttatgt taagaagaat gaaaaatata
105001 aacgtactga aattatcggt aaaaaagatt atacagtaga gtctttaaca gaagatttaa
105061 atgaagactt cgaggataat caaattatga gttatgtatt tgatgatata gaatttacag
105121 aggttcaaag tgagttactt aaagaattac ttattaaccc tgaaagagaa gatgatgcct
105181 ttatcgtttc tcaagtagcg gaaaagttg atatgaaaag aaagaagta gcaagtgagt
105241 tgacagaact cagagactat gttagattta aaataaatgc ataccatgag tactatgcta
105301 agaaagaatt aaataaccat agagttaata ctgaaaatca tatttgggaa aactagttac
105361 agtgccttcc ttgtgttata ttattatcga gaattcaata ataaagcata gggaaggctt
105421 ttttctatgt cttatagaat gctttaaaat agattactaa aataaagatt ggagattaag
105481 cttatggcta aaaagaatgt taatgatgta ttacaacaag aatctgttac agtagcagat
105541 aagtatttac aagttaaagt taaccgtgac ggttatactc gtacacatga aggacaatat
105601 gcgtacaaag tagtttcaga gggagaagaa ttattcttat accctgtaca aacagatggt
105661 aaaggtacat taaatgtaat gaagaaatca cctattgctt acactgatgg agacaatatc
105721 catttcgtag taaacacagt agtagaccct tataatcact catttatccg tactgaagat
105781 attaaaggat tagataaagg taaacaactt attcaagctt tcttagcttt cgttgaagac
105841 cgtttcaaat ttggtgttta taacgtattt gttgcaaaca acaaagagga tgtattatct
105901 attgtagacc ctacagataa tgatgcagat gaagttaaag atagtttaga gcacgcacat
105961 gaagatgtaa ttgcggattt ccctgctagc cctgctcgta aggacgttaa aggcgtagat
106021 tcaggagaag gtcaaggaga cacttcagaa ccatcagcac taagaacgt tcaagttact
106081 cctaaggaag acggagcaga cgtatcagca gaataatata tagataagga tggtaaattt
106141 ggctaagtta aattataca aaggtaatga gttactaaac agcgtagaaa aaacagaagg
106201 aaaatcaaca atcacgattg agaatttaga tgctaatacg gattacccta aaggtacttt
106261 taaagtatca ttctcaaatg attcaggaga gtcagagaag gtcgatgttc ctcagtttaa
106321 gacaaaagca attaaagtta tttcagttac ccttgacgtt gatagtttag accttacagt
106381 tggagatact caccaactat caacaactat cacgcctagt gaagcatcta caaaaatgt
106441 gtcatttgaa tcagacaaat caggtgttgc tagcgtaaca tcagaaggct taattgaagc
106501 agttagtgca ggaacagcta atgttactgt aactactgaa gatggtagtc acactgatat
106561 tgttgctgta acagttaagg aacctattcc tgaagcacct gcagacgtaa cagttgaacc
106621 tggtgaaaat agcgcagata ttactgtata ggaggacaat aaagaatgga aaagacatta
106681 aaagtttata gtaatggtga agttgtgggc tctcaagtag ctaataacga tggagctact
106741 acagtatcta ttacaggctt agaagccgga aaaactatg ctaaaggaga ttttaaagta
106801 gcatttgcta atgattcagg tgaatcagaa aagtagatg ttcctgaatt tacaactaaa
106861 actcctactg aagaaccttc aggagacgca taataattaa gaccaactaa aaagttggtc
106921 ttttttttatt gacaattat aatatctatg atacactata taagaattaa gaaaaggagg
106981 ggaaagtaat ggatattcca acaatatat ttagaaatcc atatgattat acgaaagtaa
107041 aaaaattaat ggaaaacaaa gagcagtata ttgtagtaaa gtttgattct gtttctgttc
107101 ataatttaaa tgttcaaggt atgatgaatg tcatccaaga ttacctacac atctatggtt
107161 acagagttaa agagtacgga caagaaaatt cttctaaaga tgatgaaaga gacgttaaag
107221 gctacttata tgaaagagta ggtgagtagg gtatgggaat tatagtaaac tccaaccata
```

```
107281 ttcaatcaga cactttatat gagtatgata gcttttttga tattgagaaa gtagatacat
107341 ttgaagaagg attgctttca atacaggatg agccaactgt tttagcagga ttcatctatg
107401 atgatatcac atttaataag gtcattaatt ctaattcaga tattgatgat tatattaaga
107461 ataatgatat ttattatgtc tctgatatag gattacttcc tgatacttt atcactgttg
107521 attctgatag aaaatattat tcattattac aacagataac tgagttaagt aaagacccstt
107581 ttcctaaatg ggtagaggat gatgcaaaag gttaactaa gtattataac tttcaagatt
107641 ttgaagatgt atttgattta aatagttttt acaaaaaaga agttgacatg gtaagagaaa
107701 agtgctataa taatggtaat gtatatttat tatatgaggt tctgcctgat tataaattac
107761 ctctagctta tagtttactt tcaaacaagg agcatggtat tgttattatc ggttcacaga
107821 cacgttctaa taatgatata ctgacttttt atgttaaagg tatggatgct aaggcaatag
107881 ctagtatgtt caatgtagaa catgattatg attctaatat tttccataca tttgtaaaca
107941 gtcacattaa tattttagga aatcaaataa ctaagtttat aagagagaaa ggaagcagtt
108001 atgagtaact ataaaacaat agaagaagta caagcagtta ttattggggt attatttaaa
108061 gatgaaggta aaattgtaac atctaagttt aataaaatta ctaaagagtt tggtttagat
108121 agaatcggta aagatgacct taagaaatt gtagaggata ttagacaaga cgcttatcta
108181 aatgaactta aaaacaaagc aattaaaggt aaagtaacgt taggtgattt aaaagatgtt
108241 gcagataacc aagtattcga aggtaataac taccatgaag aagtatctac ttatgtagta
108301 gctaaagaaa aagaattgtc tcacttaaga gaacagcgta agcacaatag gcatactgca
108361 taccctcaaa ttatgtttga tgaacttaaa gaacatatgg ttaaggaatt acaaggggaa
108421 acattagtag aacatcacgg aagtaaagct aatattaatg atacagagct aattgtgtta
108481 ctatcagatt tccatattgg aagtattgta tctgatatga ctaatggtaa atatgattt
108541 gaagtctta aatcaagatt aaatcattt attaatacaa cagttaaaga aattgaagat
108601 agggaaattt ctaatgtaac tgtttacttt gttggggact tagtagaaca tattaatatg
108661 agagatgtta accaagcatt tgaaacagag tttactttag cagaacaaat ctctaaaggt
108721 actcgattac ttattgatat cctaaatgta ctatctaatg tagtttcagg agaactaaga
108781 tttggtatta ttggtggtaa ccatgaccgt atgcaaggta acaagaatca gaagatttat
108841 aatgataaca ttgcttatgt agtgttagat tctttattgt tattccaaga acaagggcta
108901 ttaaatggtg tagatattat tgataatcgt gaagatattt atactattag agatacctt
108961 ggcggtaaat ctattatcat taaccacgga gatgggttaa aaggtaaagg taatcatatc
109021 aataaattta tcttagatag tcatattgac ttattaatta caggtcatgt acatcatttc
109081 tcagtaaaac aagaagattt taatagaatg cacatcgtag cttcatctcc gatgggatat
109141 aataactatg ctaaagagtt acatttatca aaaactaaac cttcacagca gttattattt
109201 gtaaataagg aaaataaga tattgatatt aaaacagtat tttagatta aggatggtta
109261 ataaatggat acaattttta ttataggtgt agcgtttata acttttgcaa catttaacat
109321 agtctttaga ttatttgatt tatggactac agagaaaaaa atggtaagtc aaggacaacc
109381 tccactaagt aactttgagt actatcatgt gatagtacct tacttagtag gtgttattgt
109441 tattatactg agtattattt ttagggattc cttgtattcc gcacaatcag ggttcggtgt
109501 tattattaca agctttatt acatgctagt ttatgttata attggtcttg tagggtcatt
109561 tgtacttaca atattccaag ctagaaaagc tagacagtat caaacacagg aggataataa
109621 tgaagttcaa tgatatttat gagcaattaa ttaaaaatga tacagtacaa aacattcatg
109681 agtctcaaga tgacaaagga aatatttata caatacagtt tgataaaggt aatgataagt
109741 atttatttaa tgttattaat gatggattct tgaaagaaat gacaaatggt atggtagacc
109801 atcctgaagg tcagccatat tcagtaagtt taatcaataa agaaacacct agtatgtcag
109861 tgaaacaata tttaacagat gtagaagata ttgtacctac tattagaaaa atggaaaagg
109921 atttcttata gagtcaagtc tttacttgac tcttttact atatatggta tattaatata
109981 gaggtgactt aaaaatggat tttaattta gtgctttga taatgctca ttgcaatga
110041 gaattagtga gggtgtatac tatttcaatg atacgcctta ttactttatt gagcatgtag
110101 aagaagaat gtctgagtat gttattgtat atgcataca tgacagagag gaaaaagaaa
110161 atcctcagaa gaaatataga atagaaccctt accaacgtac aataccggga ggaacacctc
110221 ttagtaattt aattaagagt atgatgcctc aacgtaagta tcctaagaag gttacagaag
110281 acctatatt tgtagctaat gttattccstt taggaacaga tacagtaaca ggtaaaaccg
110341 gtaaaggatt ttttgaaaga gataaggata gaactatcta ttctcaaaag gaaccaacta
110401 aagtcgttca tggtcaatac acaggtgttt ttataggtct aacaagtgtt aagtggaata
110461 gaacatatac cccctagaa agtgttgttg agtactacaa aagggttaaa ggagataggt
110521 taaatgtcta atgatgtagt taagttctat gaaaaagata ttaaagacct tatcagaact
110581 aaaaaacaca tgttcaaaga cgatgaaata actagtgata taaacgatat acgaatcttc
```

Figure 18 (contd.)

```
110641 aatgagaaag tcatttgtca aggtaaatgt agaacagatt gtttagtgtt agaccgtaat
110701 ggtacagtaa tgggtataga gataaaaaca gaacgagact ctacacaaag attaaataac
110761 caattaaaat attatagtct agtatgtaag tatgtatatg taatgtgcca tgacaaacat
110821 gtacctaaag tagaacaaat acttaaaagg tacaaacata atcatgtagg tataatgagt
110881 tacattagtt ttaaaggcaa acctgttgta ggtaaataca aagatgctac accatcacca
110941 catagaagcc cttatcatac aatgaatata ttatggaaga caaacttaat gacaatactt
111001 agattgatta gagaccctca tacgtataga acagggtata gctataatgc tagtggtaga
111061 tatagtggag gggaaggtaa tttctcccaa acaactcaaa gtaaaagaat gaaaaaacct
111121 gctattatta accaataat tcattatgta ggggtagata atacttataa actctttaca
111181 agaggtgtta tctatggtta taataatagg tgggaagtta tagaagaaga tttctttaat
111241 actatgaaga atggggtaag agtaattaat gagcaaagac aaaccaaata gacgtaaaga
111301 gatacagcat caacctgtta actttgcccc tacgaatact ttaacaggag ctaataatag
111361 tttctttgct aaaaagcctt cagagcctaa agatgcaaca tctgttattg aatatcgtat
111421 actatttatt aaaagatttg ataacgtaac aagtacagat gtgaaattac agaaaaagta
111481 tgcactaaat cttattagtg aagcacttga tgttaaagaa acttacttgt ctcttaagca
111541 aaaaggaaaa aaaacagaat ctattttgca tacagataga gtttatatg ttcatagagg
111601 taaaaaactt attggaaagt gtagtatcag agaacaaaga acatttaagg gtaaacattt
111661 gatattata ttcaaaacaa gacatagagt taaagcagaa aggaaagata aataatgtta
111721 aaaggatttt cagaacatgt agacaaacct acaactatta agacctata caagacctta
111781 acaagtggta aagtagaatt actaggtgta tcttacgata gtgattactt cccttcaggt
111841 gttacagtac aatcttacat tgaggatata ggtaatgaag atgagggtc acagtttgtt
111901 aataaggtaa atgtagtaga atcaatgaaa caggctgtag taggtatgaa taatcaatta
111961 ggttcttcag gtcttggcta tgtgagaact gaacaactta aaaagagtt ggaagagact
112021 ggactaatga cagatttact tgctagaggt actaacttaa cctctactaa gaaagtagat
112081 attgtaagta cttttattga gcctgaggta acataccaaa atattactat agctaaagat
112141 attaaactac gtttgtataa agtagaagaa gaatcaccat taatggtta cactcatatt
112201 gtatacttac ttactacaga aaaactatat gatggtcaaa cactcttcgg tatgctctct
112261 aaaaaagata agttatctaa aggagatact gataaaattat tagcattctt cagaaacaat
112321 agtttaataa gtaaaagtgt atttgtgtt aagttattaa gtaaagacta ctactttaat
112381 ttatataata cacatgagac agggatattc ttttagaag acacagatgt tattactatt
112441 gcttgtggtc agtcatatgt taaagttaac actaaagata ttaagtctag ttatgttaaa
112501 attgaagata agactcataa attaactgag ctagtaatta acctaaaggg tgacgacaca
112561 ttaactattt tattctagga aaatgttata aatatgtgat aattaagtat aaatatacgt
112621 tatataagaa gttttcataa tgttttttaat acagaaacta gttaagtttt ttctacttgc
112681 tctagtttct gtgaaattat atttatgaaa agtaaaaata tcttttaggt aaaggctttg
112741 taaatagtta aaaaatatat taaaatttta tacaaagtag ttaataaaat tatattcat
112801 ttatatatta tgaaataata acagaaattg tgatatatta tatagtgtaa ccttgaaaca
112861 gttgatgttg taggggtttgt ttatgttcgt taaactggtt tcagaacatc agttaccata
112921 aataaatgac agttaaggag agctatataa tggctagaaa aagaatttta agaaataaaa
112981 acagtgatat aaaagttgtt cctgataaag aaaaagaaag tatattatct aagttatacc
113041 ataataagtt actacgttca aaggtagata atgcattaga tgaagatatg agttatgatg
113101 atattataga attatgtaaa gaatatgatt tagaattgtc taaatcagct attacaagat
113161 ataaaagtaa aagaaaagaa gctattgaaa atggttggga tttaggagaa ttaattgata
113221 aacgtaaaaa aacaagtgta aaagatatta aggaaaaaga aactcctata ttagaagagg
113281 agcaacttc tccattcgaa caatcaaaac atcacacaca aacaatttat gatgatattc
113341 aagtactaga tatgattatt tctaaaggtg caaaaggatt agagtttgtg gaaactttag
113401 accctgcttt aatgatacgt gcaatggaaa ctaaagataa gattaccgga aatcaattaa
113461 aaggtatgtc atttattgga cttagagaat tacaattaaa acaaacagct caagatacag
113521 ctatgagtga agtattatta gaatttatac ctgaagagaa acatgaagag gtattacaac
113581 gattagaaga actacaaaat gaattctaca aaaatctaga tttagatgag gaaagtagaa
113641 aattaaaaga agctcttgat agagtaggct atacaattta gatagtgagg ttagagtaat
113701 ggcagatgag attagtttaa atccaataca agatgctaag ccaattgacg atataagtaga
113761 tatcatgaca tacttaaaaa acgggaaagt actgagagtt aaacaagaca accaaggaga
113821 tatccttgtt agaatgagtc cagggaaaca caaatttact gaagtatcta gagacttaga
113881 taaagaatca ttctactata aaaggcattg ggttctctat aatgtatctg ttaactctct
113941 tataacattt gatgtttatc tagatgaaga atattcagaa acaactaagg ttaagtatcc
```

```
114001 taaagatact attgtagaat atacaagaga agaccaagaa aaagatgttg ctatgattaa
114061 agaaatactt acagataata atggtaatta tttctatgca cttataggggg aaacaatgct
114121 ctttgatgaa aataaattaa ataaagttaa agattagggt tgacagctcc tatagttat
114181 gatatagtat atgtatacta aaagtaaagg agctaacaat tatgtttatt tcattaaatc
114241 aagaagagaa agaattatta actaaagagg aaagtaaata cacaccatta gaaacatcaa
114301 gagagtttaa cacacctaaa gaagaattca ttgtaacaag ctataatgaa ggtaaaccttt
114361 tagattacat tgcaaaagaa gctaaggtaa gtatgggatt aatttacaca gttctaaact
114421 actataaagt aggtaagcgt aataagaaat cacctgtaga agaaagaatt gcacatatct
114481 taaaagataa aaacttagtc aaagagatta ttaaggatta ccaatatatg aatttacagg
114541 acatttatag taaatataat cttcataaga atggtttata ttacatctta gatttatacc
114601 atgtggagag aaaatctgaa cttaaggaca aagcattaga agaggataat attgtcgttg
114661 agtaagtaaa gaggttataa tatgagaaat aaaaaatcat ttcaagagca gttaaatgac
114721 atgcgtaata aagagaaatg ggtatctgaa gaggagttca ctgaagaagt ggctcctcct
114781 gaagaacctg aagtagaaga agaaaaacta tatactttaa atgagttaaa agagagctta
114841 ctagatgctc aaggattaaa agatgttgta gctgattttc ctgcatctaa agatttatat
114901 gaacctaata agttatatat ctgtacaata cctaaaggat atcagtctac cgaagtacaa
114961 ccaggacaat atattggtat tagtactgga ttattatcag agtcagaaga cttcagccat
115021 ttaagaggtc aaatgcctag aaacttatat gaaacttctc atgttttaaa accttgata
115081 cgtattaata atacaaatat tgaataccaa caacatgagt tacttgaaga cattaaggat
115141 gacaaaaaga tatatgatgt agagttagaa gacttaagat tagcaacagg agaagaagtt
115201 tctcatttag aaattgttga taataagttt tttgaaagtc gtattaatga agttcttgac
115261 cgatacactg aactaacgga ttccaatgat ttacttaagt actatagtaa attacgagaa
115321 ttagtaggta gtgacaaaat gatttattgt tcactcctcg ataaatgtgt taaaattata
115381 gattaatagt agtctcctct tatattataa ttgtaagagg ggacattttt gtatagaggt
115441 gttaattatg tcaagaaaag caagtatatt ctatatacta gtggttattg tttggcttt
115501 ctctatctca tcttattata tatcttcttt catgtatcac gacaaagcaa aaaatgaagt
115561 ctctactgag ttatcgaaca caggaaagat taaagaagaa aagaacgtag aatttgtcgg
115621 tgactacaca ttgaaaaaag tggaagataa taaagcttat tttatggaaa cattacctac
115681 ttacctacca ggtagaacag gagataacag catagatatg aggtactaca aaacaagtag
115741 atttaaggaa ggggtaaatt tcaagcttat taggggtatat actgaagatg gagaagataa
115801 tccaattcat aagtataggt ttgaagcagt accaaccaaa aagtaataag gaggtgactt
115861 aaatgacaac attaattgtc gtcatcttta ttgctatcat ttattactta tggaacagtg
115921 attgagtcaa gttaattctt gactctcttt ttgttttatg gtatattaat atatagaaag
115981 gagagattaa ctatggaaat ggcagattta gaaagatttg atgcatttgt aagactaatt
116041 tcagatgatg agctttcgga ggaaagaata ctggagttaa gcgtagactt actaaacccg
116101 atactagaag gaggtacagc ttacaaggct aaaaaacgta ttaagagtaa atttggtaag
116161 ttagaagcaa aaaattttaa acgaaactat aaattcttac ttaagtcgat agctcaaata
116221 gaccaaagga gataggacaa tgacagaaag ggaaaaatta attaaagata ttgaagaggc
116281 taatagagac atacagttac agttaaaaga agtagataat tataaggaca gcatacgttc
116341 taaaggaaca agaaattata tttctacaaa ggtattagat tctattatgg ttggtttcat
116401 agttagtttt ttaatactca ttataatgcg tgtacttgaa tattttgtaa caggtaatgc
116461 tgtttactca ccttagcgc ctgcagttat tattatgttt gtttagcac taggtacatg
116521 gaaagtaagt aagatgaaca aaatagtatc ttatagagga actattaaga tgtactggga
116581 actaagtaat gctgagcaaa aacaagctaa ggtatttaag tatcctaatg atgaagtaga
116641 tattgaccag ttatatagtg ctgataaagt atctgttgat gcactttag tgggtatcat
116701 taaaaattaa ataaatttat aaatacctgt tgacagcctg ttgacagcag gtattttta
116761 tagtatactt tagatatataa gaaaaaggag gtaatataat gatacccgta atagttatac
116821 ttattggact catattattt ttatctagcg gttataagtt ggtattgggt aagtattatg
116881 atgatgtaga tttaaaaata ctatttacca tatttggtgt tgggattgca ttactacttg
116941 gaggattat attataaagc aggagctatt ttattttaag gagaggtaaa tatgaattat
117001 agagatttta ttcagattg tattagcggt ggttacaacg tacacatcag tgttacagaa
117061 aaacgagtac acattattc tgagatgaca tcagcatctt accctaaaaa ggaaattaac
117121 ttagatgaac tacaagctta tgtgtactat atgaataatt tggaagtca aattacaacg
117181 gagggggttat aaatggaatt ggtattaat attgtagcag tattggttgg tatgtatgct
117241 atttatttct atgttacaaa gttagtactt ggcttatcag gtatttaat tgttttaggg
117301 atggctattg gtctttactt ctacttagac tatttaaatg tcagagaaaa tgttattcga
```

```
117361 ttagtttcag taatgttcgg agctttctta tttagtattg aaatgattta taataaaatt
117421 atgttcgaaa ttaaaaaaag caatgttcag aagactgtta gagtgtatga taaagagcag
117481 taatgattt accataagag tacctaaatt actttaagtg ctctctatgg taccttaaag
117541 tagcttagaa ttgaaattaa ggagatgaac aattatgtat cctgaaatag atgtggaaga
117601 attagcgtat aagctaaaaa gtacaagaga gtatttagag agcattacaa caaaagaagt
117661 agaaatttat gaaatctatc atcttaaaac aggtaagtta gttttttaaag gtgaatacat
117721 tgaggtaaaa gaattactga ggaaaatgta taaagaaaat ttaacacttg tagatgtaga
117781 tacaatgtta agcattggta aaggatttat tgatgtaatt aagaatatat cggcagaaaa
117841 tgtattccaa ataacatata aaaaggagct atcaacaaaa tgattaaaat attttcagaa
117901 gtagataaag aatacaaacc tattattact gaaaagtttc ctaatggtga gattaatttt
117961 aaatatgatg atttaaagta tttagtagaa gaggacttaa gatttgatgt tttctttaaa
118021 tgggaaaatg acgcagactt aatgcatttg tatatgttta ctaagtattt agagcaacta
118081 ggtattaaag ataaagctga attttttagag attgcatatc taccttatag cagaatggat
118141 agagtagaag aaggacataa taatatgttc agtcttaaat acattacaga attattaat
118201 aaccttaatt ataaatcggt atgggtagca gaacctcata gccctgtaac agaagaatta
118261 cttactaatt cttttgctat tgatgttaca cttaaattat taaatcagta tattgaaatg
118321 tccgaagagc ctgtaacaat agtactacct gataaagggg catacgatag atatctattt
118381 gatgtagaac gtatcttaat ggaatctaat attgaatcat attcaattgt atatggtgag
118441 aagaaacgag attttgaaac aggtaagatt aaaggtatta aaataattaa agataaaaat
118501 actttatatg ataattgtat tatactagat gacttaacaa gttacggtgg gacatttgtc
118561 ggttgtaaaa aagcccttga caaacttaag gtaagtagtg tatcattaat attgactcat
118621 gcagaacgag cttttgcaga aggagcatta cttagctcag gatttaaaga tattattgta
118681 acagactcta tgttccctaa aaataattgg gaaaaagcta ttgctaaaca tagagctaga
118741 atcaacggaa ctgaattaca aataaaagat atcgaaagat atttataaaa ggagaaaaat
118801 aaattatgct aaatccaact ttaatgtgtg acttctataa actaagtcac agagaacaat
118861 accctgaagg tacagaaatt gtatatagta cactagtacc tagaagtaat aaatattatg
118921 aacacagtga taatattgta gtatttggta ttcaatcact tgttaaaaaa tattttattg
118981 atatgtttaa taaagagttc tttaacagac ctaaagagga agttattaat gaatacaaac
119041 gtacagttaa atttacacta ggacaagaaa atcctgatgc taaacactta gaacaattac
119101 atgacttagg ttatttaccct attgatgtaa gagctttaaa agaaggtact gttgttcatc
119161 ctaacacacc tgttatgaca attgaaaata ctcactcaga tttcttttgg ttaactaatt
119221 acctagaaac tattattagt actcaaacat ggcaagcaat gactagtgct acactagcat
119281 atgatatgcg taaaatgcta gataaatatg caatggaaac agtaggtaat attgaagcag
119341 tagattttcca gggtcatgac tttagtatgc gtggtatgag ttctttagaa acagctcaat
119401 taagttcagc aggtcatgca attagtttta aaggtagtga tacagtacct gtagtggatt
119461 tcttagaatc atattacaat gcagacgtag agaaggaaat ggttgttgct tctatccctg
119521 ctactgagca ctcagtaatg tgtgcaaatg gtaattatga aaccatggat gagtatgaaa
119581 catataaacg tatgttaaca gaaatatatc caacaggcat tttctctatt gtgtctgata
119641 cttgggactt ttgggggtaat atgactaaaa ctttacctag attaaaggat attattatgg
119701 aacgtaatgg taaagtagta atcagacctg atagtggaga ccctgttaaa attatttgcg
119761 gagaccctga tgcagacact gaatatgaac gtaaaggtgc agtagaagtg ctttgggata
119821 catttggagg tactgaaact gaaaaagggt acaaagtatt agatgaacat gtaggattaa
119881 tttatggaga ctctattaac tatgaacgtg ctcaacaaat ttgtgaagga ttaaaagaaa
119941 aaggttttgc aagtattaat gttgtattag gtgtaggtag ttctctcttac caatttaata
120001 ctcgtgatac ccacgggttt gcaatcaaag caacgtatgc taagattaaa aatgaagaaa
120061 aacttatcta taaaaatcct aaaacagata gtggtaaacg ttcacataaa ggtcgagtag
120121 ctgtatataa agacggttca tgggaagata acttaacctt acatcaatgg ctaaacaaac
120181 aaaatgttaa tcaattagaa agagtatttg aagatggtaa actttataga gaccagtcgt
120241 taagtgaaat tagagaaata attaaaaata attaataaat atttaaactc cctattgaca
120301 aagggagttt tttattatat agtagggcta tagtaaataa aggagtgaaa gaaatgattt
120361 ataaaatatc aaaacataat tactctatgta ggtttgaata ttcatcttat ttacctgatg
120421 aaggatttgc atatatagat tatgtagatg tcattcttat aggtgtagat aatccaaaga
120481 agagaaaagt tattacttta aaagcagatg agtttaatcc tagtgatttt aaggttggtc
120541 ataaatataa tattataaaa atactatggt ttgagaaatg ggaatggtta cagccatagg
120601 gaggagaggt atacaatgat tatagataaa ttaaatggag ttaaattaga gattggcggt
120661 catgttgtat cattagtgt aagtaagttt aaaacgatta atggtgaaag acaattactt
```

Figure 18 (contd.)

```
120721 gattaccacc atatcaaaag aggtaaacag agatatttta gaactactga ggaattctat
120781 aatgagtaca aagaaataaa accggataag aatgagatag atgaaatgtt tgaatcttta
120841 ggttacgtaa atactgaatt agaagatgta gtaagaaacc aagagaaagt gacagagata
120901 ttaggagtta gtgaacagta tttaaaccaa ttgtcttata aggctataga ggaatatgta
120961 gaaaaaatag ttatcttaga aattaaagaa ttaaaaggag agatacaatg ataaacatta
121021 atgtaactga aaaagaaaaa ttagttgtag gtgatttagt aaaatcaaga gaagatggta
121081 catggggtat tgtagtagaa gataagcaag acttaaatgt agttgtgtta aatgacgagc
121141 cctggttatt ttataaatca ggaattaaaa gagtagaagg gcaattagaa gaggacttta
121201 aatttattaa aaacagagaa gagtatgata tagatgtagt taattcttct tataaataaa
121261 ttcacatcta cctattgact taggtagata cttattatat aatagtatac aaggagatga
121321 agtatgatga atggaaaaca aatttatgta tttttaagtg accaatacag taaagatata
121381 ctcagtttac aattaggtct tattaaggaa tggtctagga gagaactaac ttattcagat
121441 gatgtcggtt cagatgcaga tgttgttatt tgtactgata tagtaagaga tgatttcgta
121501 aaaaaactaa gtaaaaataa tagcaatgca ttatttgtat ttattagttc tagttattgg
121561 ataggttata aaggcggaga attctttgtt gcagttcaag actatgtgaa aggtatgtaa
121621 gatatgaaaa aattattaat attatttaca ttagctagca cttactatt agcaggatgt
121681 acaccggata atcatgaagg aaaagtttta ggaacaggag aatatagaga gccaactact
121741 tatatcaagt caggaagtgt tactgtacca gttattggtg aaatgaaata ctatgtagac
121801 ttagaaacag ataaaggtga agaccgtgtt tatcttaata gggaagttta tcgtaaattt
121861 gataaaggtg atgatttctc taatgtaggt aaaaaagtat ataaaaatga tgaattaata
121921 tataaagggg actaattagt atgaaacaat ttatacatga taaaaagat agttataata
121981 gtacaaatcg taatttgat attcaatatt ataaaggtat acctttacaa caaattgata
122041 gggggtatgg tcaagcaaga gctaggagat ttacaataaa taatacgaac caaaatatat
122101 ggatacctat gacatattta aaacctaatg gtactcttaa aaataacatt gatatagatt
122161 ggatacttgt taaagaaaaa tgtagttta agaaagcagg attagtaata aaaatagaaa
122221 ttacaggaga tgtattataa tgtatatatt agaaagaaca attagaggtt ttgcaggtca
122281 aacagaagat attttacctt aaaggagatg aattaataat ggagtatgaa aaaatgatta
122341 gagaaataat ggtaaactct aaagaaatgt cactagaaga taaaaaacat ttaatgagtt
122401 tattgatgag tgcttatggt gacttatcaa tactagtagc ttttgaagaa gaaaacacag
122461 cacatatgta tgaagaaata aaacagtatg atactaaaaa gttactgaaa ccaagtatgg
122521 taagtaaaga taattatatg aaataaatatg taaccaatca ggaggaataa ctaatgataa
122581 atatagaaca tgattataca ataagaactg tagataaatag aaagtatact tactatagta
122641 aacatgaatc cccagttact ttatataaaa atattataag taaagattgt attgaagtaa
122701 ctaaatatgg gaaagataaa aaagttatta tagctactaa atatattgta tctattgaac
122761 gatggtaatt acaaggagga gtagttatga atgctaggga agcacgtaaa aacactaaaa
122821 actataagga ctctaatgta gtaactaaag agcaacactt aacttatatc tataataaga
122881 taaactactt gattgcaaat agtagtagtc agggtaagac atatgtggca atgaatctaa
122941 gaacagatta tcctgatgag ttttctttat ctaaattaaa atatctaaaa gaaattaaac
123001 agcactataa agacctagga tttaatgtga aaacgcaagt aagaaaggca aagtggtcag
123061 agaaaagtgt aatcaggtac tactttaact taggctatat agacagcgtg ttagtaccta
123121 ttatacacat tagttggtaa ttacaaggag gaatagttat gttttttaaa aagaagaagt
123181 taagcaatgt agagaaacaa ataagacaaa accgtaataa agaagacaaa gaaagaaaag
123241 aacatcaaga taagttaaat acagatatgt ataaaacgta tgaattagat aaaattgtag
123301 aagaacattt aagaaaatta gacaatatat cccttgaagg attagaacta acttcagtgt
123361 gtttagggac aagacttgtt tattattatt caataggcaa ggattgggat aaacaagtat
123421 atagtttaaa cgaattagaa tatatgaaga agaaatttaa gaaactagga tttgaaactc
123481 agataacaaa cgaagatata ggatttcaac cttatatttta tttaagatta ttatgggatg
123541 cataagtaat tattattaga ggaggaatag ttggtgttgc acagttaatt acggattatc
123601 atgacggaca ttaagtattg aatattgttg actataaata agaagaaaat attattacta
123661 ctaagtacct ttgttatgta ctactattac tactactaag tacctttgtt atgtactact
123721 attactacta ctaagtacct gggaattctt ttacctctct cactcagcct attacttatt
123781 accgactttcc ctaactactt attctatagt tataataattc atttattata caatacttaa
123841 actatagtat tctactgtta atctatgctg aagcggtctt aatctatggt tattatataa
123901 taatcttata taatggtaca ttaatctagt atattacatt agaatcattc taatctagga
123961 ttttaatctt tagaccctag gaaaagtggt actaaaatat aaaaccctat aggtatggga
124021 ttcttatttt taaaattact aaaaagtatt aggttttccc tagggcaaag tttaatgta
```

Figure 18 (contd.)

```
124081 cttaaaatag taagtagcta cttatcattt agggttctat aattgagaat attgagagat
124141 aatccgcttc aattgtaatt aattgttgac aactatgaag cgggtatgct ataattaggt
124201 atagtcaaat ttaggagatg aaatagatga ttgatatata cttaggagaa ggttataata
124261 aagaatactt gtctaaagca ctcagattaa tcaatgacca tgctcctagg gagttaagtt
124321 atgattttaa taatgtagaa gcggatgtta atattcacac aatgttatat gttaaacctg
124381 aagatagatt tatatataag gatatatcct atgacttccc gggtgattta attatttgta
124441 tagttgatga tgatgctatt gtataccacc aaggtgagca gatttcaggt attagtattt
124501 taagaatact agaagagata ttttaaggag gataagtaat catgatagga ataacaatat
124561 taattacgat aatgagtata tcaactatct ctatgtatat ttatttttta gtagacttga
124621 ttcagtcaat cagatatatt agttttgata aggtaattaa cgtcataaca tttgtactta
124681 tgacagttat aatagcatca ggtattttag ctatacttgg aatatagagc tcattaaga
124741 agcggttaag tagttagagg ggatttgtcc taaaatagta taccgcttct atatggaagg
124801 ctgagaggtc ttagaattga aaggagagat ataatgattc atatattttt aactgatagt
124861 tatgataata aagtttttaaa tactgtactc agatatatta atactactag tgatagagag
124921 cttagttact taatgggtaa aggtgaagcg gatgtatgta tagaaaaggg agtatttagt
124981 aatatagaag atgttaaaat tgactctgag tttattgata gaggtaactt atgtatactt
125041 ataaatgaag atggattagt atgtagttac tacagagagg aatcatgtaa tgttggttcc
125101 tttgtaaagg agaggttata atgatagaaa ttaggttaac tgaagattat aatgacttga
125161 gtcttaaggc attactaaaa cgtattaaaa gggtagctcc tagggaatta acttatggtt
125221 tagaagcgga tatggatact acagatgtta atattggaga ttcagttcct tctagaggtt
125281 tatatgtaga gtactccagaa cgttttacta gggacttatg gataattgta caccccttcag
125341 gttatgatgc ttattatcaa ggagagaaat atggtggaga gtctttagat gagattatac
125401 atgatatgtt ttatgattat gcagaccctt ttgacttaga ttattagaaa ggagagatta
125461 taatgataga gatataccttt agtgaaaatt atgataagaa tttactaaaa gcagaattaa
125521 aatggattaa agagaccgct tcaagagaac taacttatga tattaatagg aaacctggat
125581 tggatgttta tgttaatccc tataggtgta ctaaagacga agttgaagaa tggagtacac
125641 ttcctccatt tgaagatgat atacttgtat ttatagcgga gacgtggata catgaatatc
125701 ttaagggtga atcaataggt gtagatagta tggaagagta tgtaaaggag atgtaactaa
125761 tgtttaaggt atattataca gtctaccata gaggtagtat gaaaactatt aaggataagc
125821 tagatagaag tagtttaata tacttcttgt atgatacttg gtataaagat attagtaacg
125881 tattccctaa tcactataat aaagagtttg ggagtaagag tgatgatata gatatagata
125941 aacttattga agcggttaat gaggaaggta tattacttat caatagaggt aattatgtta
126001 caataagaga atggtaggat aggataaact taggatagaa aataatttag gatgagttac
126061 aataggatag gataggatag gggggttaagt taggatggat actttaacat acactattat
126121 tcataaagaa tctgataggg taatagctag cggtttaaat gagacagaaa ctatgaacctt
126181 agttcaaagg atgataaata ctaatctagt tactgatata tcattagatg attatatacg
126241 cagaccacat ggaaagatag atgtagtcaa tttactagta gatattagaa gacaaggcgt
126301 atttgatttc aatcacattt ggcacgtagg ataggaggga taggatgata gttatatata
126361 cagatgtttc taaggattat ttaaaagacg agttcttacc ttggcttaat gaaagggata
126421 gatacttaga atactataaa gatgaattac ctgaggtatt agattcctct tatattgtat
126481 cagttgtata ctgtaaggat atggaaggtc tattagaaag aaaagacatt gttcttgata
126541 atagttataa tgaacctgta gctttattag gtgttcctga gtttttggt aattatagta
126601 attatttcta ttatagagga gaaagtatta gtaaacatga cctaggagaa attgttaggt
126661 taaaagcttg gcaacgtatg ggtggggatt gactaagtag ctctccctaa tttcactaag
126721 tagctcccta ggaattgcct aagtagctcg gtatgatttt accctaagta gctccctctg
126781 ttttctacta gttattttta accgcttcag gtgtctatat atatatagac ggttggaata
126841 atatcagacc gcaaaaataa atacactagg atattattcc cagtgtatta tataatttt
126901 ttatagaata tttataacat tgtattcaaa ttcatttact tcatgttgtg atttaattaa
126961 attttttaatt aatccgtttt gtgttttata ctcttttatt agttttttcat tttctataat
127021 taaattatta aattcttctt ttgttgtttc ctcatctaca taaaatttac tttcatatat
127081 ttcataatat ttttttatctg ttccgccatc taaatcatct gatatttgat aatttttgaa
127141 tataatttct tttgttttcta attcattac taataattgt gattttgcat attgtaatac
127201 atcttcattg tcccacattg gaatatagtt tattttcatt taaatcaaat cctttctta
127261 taatttttt atataatatt tgtagaagcg gttggggttt gtccctttgcc ttactacact
127321 ttatatatta cagtatagtt attcagaagt caatactttt gagtaactt ttttaaattc
127381 tttttcttc tatataatag tagtttttag ccctaaaaat gttttaaaa gaatttgcat
```

Figure 18 (contd.)

```
127441 tttcttattg actttattat catatggtag taatataaag gtacagcaag ggaacagcaa
127501 caagatatta gaattatata aaaaaattat ttaatttgag atgatttaaa tggatgtaaa
127561 agaaattgca aatactataa tggagttgtg gcaaatggac ggctacagat gtgcagaacc
127621 tccattatat gaaagcacac taaaccacac acgcacacac acggcgttaa ttgtttctat
127681 taatggaaac tatgacacag tgcagatgtt ccgcaaaacg cctataatga gcatgagagg
127741 gcaaagccaa ccggctagca tgttagttaa tgtgattgac gatgtaatta taatcgtata
127801 tgaaaatgta gtgtacggag ttcaaaacaa agaaataaaa tttattgaag aaatttaaaa
127861 atagggggttg caatcctcaa gcatctatag taatataata ggtgtagggg atagcaacac
127921 acctcaaaa
```

RECOMBINANT K AND 812 BACTERIOPHAGES AND USES THEREOF

TECHNICAL FIELD

The present technology relates generally to compositions including recombinant K or 812 bacteriophages, methods for making the same, and uses thereof. The recombinant K or 812 bacteriophages disclosed herein are useful for the identification and/or antibiotic susceptibility profiling of specific bacterial strains/species present in a sample.

SEQUENCE LISTING

The instant application contains a Sequence Listing which has been submitted electronically in ASCII format and is hereby incorporated by reference in its entirety. Said ASCII copy, created on May 11, 2018, is named 102590-0608_SL.txt and is 715,045 bytes in size.

BACKGROUND

The following description of the background of the present technology is provided simply as an aid in understanding the present technology and is not admitted to describe or constitute prior art to the present technology.

Bacterial infections may complicate a patient's existing medical condition, and in some cases, may lead to death. Patients suffering from various bacterial infections often present with similar symptoms, thus making it difficult to accurately identify and characterize the bacterial species or strain responsible for the infection. Accurate identification of the bacteria through conventional lab tests can be challenging and may require incubation periods of up to several days. Additionally, some bacterial strains are not amenable to culturing and in vitro analysis in light of their fastidious nature. In other situations, the observable behavior of some bacterial strains is not readily distinguishable from others. Moreover, individual strains of a particular bacterial species may exhibit resistance to otherwise effective antibiotics.

Early and accurate identification of the bacterial strain(s) responsible for a patient's illness and determining its susceptibility to various antibiotics is an important aspect of the treatment selection decision process.

SUMMARY OF THE PRESENT TECHNOLOGY

In one aspect, the present disclosure provides a recombinant K bacteriophage nucleic acid sequence, wherein the nucleic acid sequence between position 70,285 and 71,657 of SEQ ID NO: 1 is replaced with a heterologous nucleic acid sequence comprising an open reading frame that encodes a reporter protein, wherein the reporter protein is a bioluminescent protein, a fluorescent protein, a chemiluminescent protein, or any combination thereof.

In another aspect, the present disclosure provides a recombinant 812 bacteriophage nucleic acid sequence, wherein the nucleic acid sequence between position 79,551 and 80,923 of SEQ ID NO: 2 is replaced with a heterologous nucleic acid sequence comprising an open reading frame that encodes a reporter protein, wherein the reporter protein is a bioluminescent protein, a fluorescent protein, a chemiluminescent protein, or any combination thereof.

Additionally or alternatively, in some embodiments of the recombinant K or 812 bacteriophage nucleic acid sequences, the open reading frame of the heterologous nucleic acid sequence is operably linked to an expression control sequence that is capable of directing expression of the reporter protein. The expression control sequence may be an inducible promoter or a constitutive promoter. Additionally or alternatively, in some embodiments, the recombinant K or 812 bacteriophage nucleic acid sequence comprises a sequence selected from the group consisting of SEQ ID NO: 5, SEQ ID NO: 6, SEQ ID NO: 7, SEQ ID NO: 8, SEQ ID NO: 9, SEQ ID NO: 14 and SEQ ID NO: 15.

Examples of fluorescent protein include, but are not limited to, TagBFP, Azurite, EBFP2, mKalama1, Sirius, Sapphire, T-Sapphire, ECFP, Cerulean, SCFP3A, mTurquoise, monomeric Midoriishi-Cyan, TagCFP, mTFP1, EGFP, Emerald, Superfolder GFP, Monomeric Azami Green, TagGFP2, mUKG, mWasabi, EYFP, Citrine, Venus, SYFP2, TagYFP, Monomeric Kusabira-Orange, mKOκ, mKO2, mOrange, mOrange2, mRaspberry, mCherry, dsRed, mStrawberry, mTangerine, tdTomato, TagRFP, TagRFP-T, mApple, mRuby, mPlum, HcRed-Tandem, mKate2, mNeptune, NirFP, TagRFP657, IFP1.4, iRFP, mKeima Red, LSS-mKate1, LSS-mKate2, PA-GFP, PAmCherry1, PATagRFP, Kaede (green), Kaede (red), KikGR1 (green), KikGR1 (red), PS-CFP2, PS-CFP2, mEos2 (green), mEos2 (red), PSmOrange, or Dronpa. Examples of chemiluminescent protein include, but are not limited to, β-galactosidase, horseradish peroxidase (HRP), or alkaline phosphatase. Examples of bioluminescent protein include, but are not limited to, Aequorin, firefly luciferase, *Renilla* luciferase, red luciferase, luxAB, or nanoluciferase. In some embodiments, the bioluminescent protein is nanoluciferase.

In one aspect, the present disclosure provides a vector comprising any of the recombinant K or 812 bacteriophage nucleic acid sequences disclosed herein, as well as bacterial host cells comprising the vectors of the present technology. The bacterial host cell may be a natural or non-natural host for K or 812 bacteriophage.

In another aspect, the present disclosure provides a recombinant K or 812 bacteriophage comprising any of the recombinant K or 812 bacteriophage nucleic acid sequences of the present technology. Also provided herein are recombinant K or 812 bacteriophages comprising a nucleic acid sequence selected from the group consisting of SEQ ID NO: 5, SEQ ID NO: 6, SEQ ID NO: 7, SEQ ID NO: 8, SEQ ID NO: 9, SEQ ID NO: 14 and SEQ ID NO: 15.

In one aspect, the present disclosure provides a bacterial host cell comprising a recombinant K or 812 bacteriophage disclosed herein. The bacterial host cell may be a natural or non-natural host for K or 812 bacteriophage.

In one aspect, the present disclosure provides a method for identifying at least one bacterial strain or species in a test sample obtained from a subject comprising (a) contacting the test sample comprising bacterial cells with a recombinant K or 812 bacteriophage of the present technology; and (b) detecting the expression of the reporter protein of the recombinant K or 812 bacteriophage, wherein detection of the reporter protein indicates the presence of at least one bacterial strain or species in the test sample. In some embodiments of the method, the expression of the reporter protein is measured in about 5, 10, 15, 20, 25, 30, 35, 40, 45, 50, 55, 60, 65, 70, 75, 80, 85, 90, or 120 minutes after contacting the test sample comprising bacterial cells with the recombinant K or 812 bacteriophage.

In another aspect, the present disclosure provides a method for determining the antibiotic susceptibility of a bacterial strain or species in a test sample obtained from a subject comprising (a) infecting a plurality of test samples comprising bacterial cells with a recombinant K or 812 bacteriophage of the present technology and an antibiotic, wherein the plurality of test samples is derived from the subject; (b) detecting the expression of the reporter protein of the recombinant K or 812 bacteriophage in the plurality of test samples; and (c) determining that the antibiotic is effective in inhibiting the bacterial strain or species in a test sample when the reporter protein expression levels of the recombinant K or 812 phage infected bacterial cells in the test sample are reduced relative to that observed in an untreated control sample comprising bacterial cells, wherein the untreated control sample is derived from the subject and is infected with the recombinant K or 812 bacteriophage of the present technology. The expression of the reporter protein may be measured in about 5, 10, 15, 20, 25, 30, 35, 40, 45, 50, 55, 60, 65, 70, 75, 80, 85, 90, or 120 minutes after infecting the plurality of test samples comprising bacterial cells with the recombinant K or 812 bacteriophage.

Additionally or alternatively, in some embodiments of the methods disclosed herein, the test sample is blood, sputum, mucus, lavage, saliva, or a swab obtained from the subject. In some embodiments, the subject is human.

In certain embodiments of the method, the antibiotic is selected from the group consisting of rifampicin, tetracycline, levofloxacin, ampicillin, penicillin G, methicillin, oxacillin, amoxicillin, cefadroxil, ceforanid, cefotaxime, ceftriaxone, doxycycline, minocycline, amikacin, gentamicin, levofloxacin, kanamycin, neomycin, streptomycin, tobramycin, azithromycin, clarithromycin, erythromycin, ciprofloxacin, lomefloxacin, norfloxacin, chloramphenicol, clindamycin, cycloserine, isoniazid, rifampin, teicoplanin, quinupristin/dalfopristin, linezolid, pristinamycin, ceftobiprole, ceftaroline, dalbavancin, daptomycin, mupirocin, oritavancin, tedizolid, telavancin, tigecycline, ceftazidime, cefepime, piperacillin, ticarcillin, virginiamycin, netilmicin, paromomycin, spectinomycin, geldanamycin, herbimycin, rifaximin, loracarbef, ertapenem, doripenem, imipenem/cilastatin, meropenem, cefazolin, cefalotin, cephalexin, cefaclor, cefamandole, cefoxitin, cefprozil, cefuroxime, cefixime, cefdinir, cefditoren, cefoperazone, cefpodoxime, ceftibuten, ceftizoxime, lincomycin, dirithromycin, roxithromycin, troleandomycin, telithromycin, spiramycin, aztreonam, furazolidone, nitrofurantoin, posizolid, radezolid, torezolid, azlocillin, carbenicillin, cloxacillin, dicloxacillin, flucloxacillin, mezlocillin, nafcillin, penicillin V, temocillin, bacitracin, colistin, polymyxin B, enoxacin, gatifloxacin, gemifloxacin, moxifloxacin, nalidixic acid, ofloxacin, trovafloxacin, grepafloxacin, sparfloxacin, temafloxacin, mafenide, sulfacetamide, sulfadiazine, silver sulfadiazine, sulfadimethoxine, sulfamethizole, sulfamethoxazole, sulfanilimide, sulfasalazine, sulfisoxazole, trimethoprim-sulfamethoxazole (Co-trimoxazole) (TMP-SMX), sulfonamidochrysoidine, demeclocycline, oxytetracycline, clofazimine, dapsone, capreomycin, ethambutol, ethionamide, pyrazinamide, rifabutin, rifapentine, arsphenamine, fosfomycin, fusidic acid, metronidazole, platensimycin, thiamphenicol, tinidazole, trimethoprim(Bs) and vancomycin.

In one aspect, the present disclosure provides methods for making a recombinant K or 812 bacteriophage in a bacterial host cell comprising (a) recombining in vivo a first K or 812 bacteriophage genome with a heterologous nucleic acid sequence in the presence of a recombination system under conditions to produce a recombinant K or 812 bacteriophage genome, wherein the bacterial host cell is infected with the first K or 812 bacteriophage genome, and wherein the heterologous nucleic acid sequence comprises an open reading frame that encodes a bioluminescent protein, a fluorescent protein, a chemiluminescent protein, or any combination thereof. The first K or 812 bacteriophage genome may be recombinant or non-recombinant.

Additionally or alternatively, in some embodiments of the methods disclosed herein, the recombination system is endogenous to the bacterial host cell. In certain embodiments of the methods disclosed herein, the recombination system is a non-endogenous recombination system that is induced in the bacterial host cell. The non-endogenous recombination system may comprise lambda Red proteins Gam, Exo, and Beta operably linked to an inducible promoter. In some embodiments of the methods disclosed herein, the inducible promoter is araB and the non-endogenous recombination system is induced by the addition of arabinose.

Additionally or alternatively, in some embodiments, the method further comprises propagating the recombinant K or 812 bacteriophage genome in a bacterial host. For example, the bacterial host may be transformed with the recombinant K or 812 bacteriophage genome via electroporation. The bacterial host may be a non-natural bacterial host cell or a natural bacterial host cell for K or 812 bacteriophage.

Also disclosed herein are kits comprising one or more coded/labeled vials that contain the recombinant K or 812 bacteriophage of the present technology, instructions for use, and optionally at least one antibiotic.

BRIEF DESCRIPTION OF THE DRAWINGS

FIG. 8A also discloses SEQ ID NOS 6, 16-17, 6, 16-17, 18, 18, 6 and 6, respectively, in order of appearance.

FIG. 8B also discloses SEQ ID NOS 7, 19-20, 7, 19-20, 7, 7, 7 and 7, respectively, in order of appearance.

FIG. 9A also discloses SEQ ID NOS 8, 21-22, 8, 21-22, 23, 8 and 8, respectively, in order of appearance.

FIG. 9B also discloses SEQ ID NOS 9, 24-27, 9, 28-29, 9, 9, 9 and 9, respectively, in order of appearance.

FIG. 13 shows the sequences of DNA fragments 4.1 (SEQ ID NO: 3) and 4.2 (SEQ ID NO: 4), which were used to assemble the heterologous nucleic acid sequence that was inserted into K or 812 phage genomic DNA at site 4, shown in FIG. 14. Nanoluciferase gene sequence is underlined, RBS and spacer is italicized, and overlap assembly regions are shown in bold.

FIG. 14 shows the heterologous nucleic acid sequence that was inserted into K or 812 phage genomic DNA at site 4 (SEQ ID NO: 5). The underlined sequences represent the homologous 5' and 3' flanking regions of the heterologous nucleic acid sequence.

FIG. 15 shows the 812 genome sequence of non-recombinant 812 phage (SEQ ID NO: 2).

FIG. 16 shows the genome sequence of the recombinant NanoLuc 812 phage of the present technology (SEQ ID NO: 15).

FIG. 17 shows the K genome sequence of non-recombinant K phage (SEQ ID NO: 1).

FIG. 18 shows the genome sequence of the recombinant NanoLuc® K phage of the present technology (SEQ ID NO: 14).

DETAILED DESCRIPTION

Figure 1A:
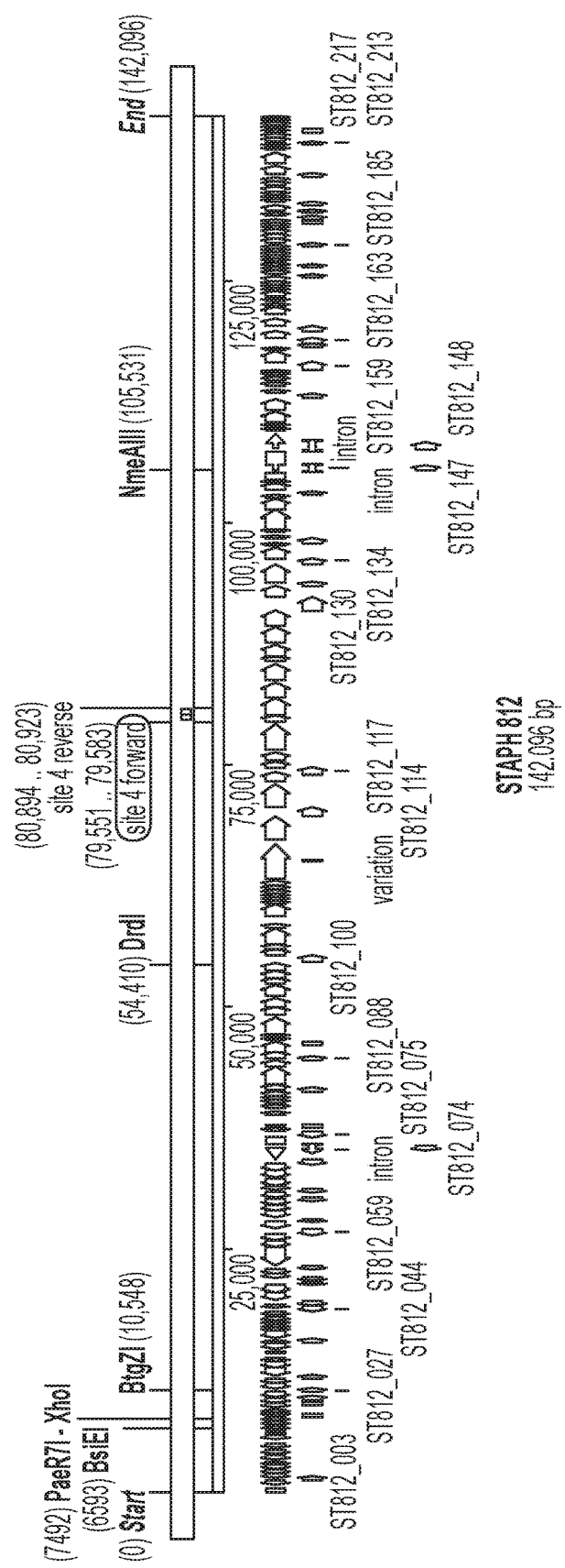
FIG. 1A shows a graphical representation of the 812 phage genome.

It is to be appreciated that certain aspects, modes, embodiments, variations and features of the present methods are described below in various levels of detail in order to provide a substantial understanding of the present technology.

In practicing the present methods, many conventional techniques in molecular biology, protein biochemistry, cell biology, microbiology and recombinant DNA are used. See, e.g., Sambrook and Russell eds. (2001) *Molecular Cloning: A Laboratory Manual,* 3rd edition; the series Ausubel et al. eds. (2007) *Current Protocols in Molecular Biology*; the series *Methods in Enzymology* (Academic Press, Inc., N.Y.); MacPherson et al. (1991) *PCR 1: A Practical Approach* (IRL Press at Oxford University Press); MacPherson et al. (1995) *PCR 2: A Practical Approach*; Harlow and Lane eds. (1999) *Antibodies, A Laboratory Manual*; Freshney (2005) *Culture of Animal Cells: A Manual of Basic Technique,* 5th edition; Gait ed. (1984) *Oligonucleotide Synthesis*; U.S. Pat. No. 4,683,195; Hames and Higgins eds. (1984) *Nucleic Acid Hybridization*; Anderson (1999) *Nucleic Acid Hybridization*; Hames and Higgins eds. (1984) *Transcription and Translation*; *Immobilized Cells and Enzymes* (IRL Press (1986)); Perbal (1984) *A Practical Guide to Molecular Cloning*; Miller and Calos eds. (1987) *Gene Transfer Vectors for Mammalian Cells* (Cold Spring Harbor Laboratory); Makrides ed. (2003) *Gene Transfer and Expression in Mammalian Cells*; Mayer and Walker eds. (1987) *Immunochemical Methods in Cell and Molecular Biology* (Academic Press, London); and Herzenberg et al. eds (1996) Weir's *Handbook of Experimental Immunology.*

Definitions

Unless defined otherwise, all technical and scientific terms used herein generally have the same meaning as commonly understood by one of ordinary skill in the art to which this technology belongs. As used in this specification and the appended claims, the singular forms "a", "an" and "the" include plural referents unless the content clearly dictates otherwise. For example, reference to "a cell" includes a combination of two or more cells, and the like. Generally, the nomenclature used herein and the laboratory procedures in cell culture, molecular genetics, organic chemistry, analytical chemistry and nucleic acid chemistry and hybridization described below are those well-known and commonly employed in the art.

As used herein, the term "about" in reference to a number is generally taken to include numbers that fall within a range of 1%, 5%, or 10% in either direction (greater than or less than) of the number unless otherwise stated or otherwise evident from the context (except where such number would be less than 0% or exceed 100% of a possible value).

As used herein, "bacteriophage" or "phage" refers to a virus that infects bacteria. Bacteriophages are obligate intracellular parasites that multiply inside bacteria by co-opting some or all of the host biosynthetic machinery (i.e., viruses that infect bacteria). Though different bacteriophages may contain different materials, they all contain nucleic acid and protein, and can under certain circumstances be encapsulated in a lipid membrane. Depending upon the phage, the nucleic acid can be either DNA or RNA (but not both).

As used herein, a "control" is an alternative sample used in an experiment for comparison purpose. A control can be "positive" or "negative." For example, where the purpose of the experiment is to determine a correlation of the efficacy of a therapeutic agent for the treatment for a particular type of disease or condition, a positive control (a compound or composition known to exhibit the desired therapeutic effect) and a negative control (a subject or a sample that does not receive the therapy or receives a placebo) are typically employed.

As used herein, "expression" includes one or more of the following: transcription of the gene into precursor mRNA; splicing and other processing of the precursor mRNA to produce mature mRNA; mRNA stability; translation of the mature mRNA into protein (including codon usage and tRNA availability); and glycosylation and/or other modifications of the translation product, if required for proper expression and function.

As used herein, an "expression control sequence" refers to polynucleotide sequences which are necessary to affect the expression of coding sequences to which they are operably linked. Expression control sequences are sequences which control the transcription, post-transcriptional events and translation of nucleic acid sequences. Expression control sequences include appropriate transcription initiation, termination, promoter and enhancer sequences; efficient RNA processing signals such as splicing and polyadenylation signals; sequences that stabilize cytoplasmic mRNA; sequences that enhance translation efficiency (e.g., ribosome binding sites); sequences that enhance protein stability; and when desired, sequences that enhance protein secretion. The nature of such control sequences differs depending upon the host organism; in prokaryotes, such control sequences generally include promoter, ribosomal binding site, and transcription termination sequence. The term "control sequences" is intended to encompass, at a minimum, any component whose presence is essential for expression, and can also encompass an additional component whose presence is advantageous, for example, leader sequences.

As used herein, a "heterologous nucleic acid sequence" is any sequence placed at a location in the genome where it does not normally occur. A heterologous nucleic acid sequence may comprise a sequence that does not naturally occur in a bacteriophage, or it may comprise only sequences naturally found in the bacteriophage, but placed at a non-normally occurring location in the genome. In some embodiments, the heterologous nucleic acid sequence is not a natural phage sequence. In certain embodiments, the heterologous nucleic acid sequence is a natural phage sequence that is derived from a different phage. In other embodiments, the heterologous nucleic acid sequence is a sequence that occurs naturally in the genome of a wild-type phage but is then relocated to another site where it does not naturally occur, rendering it a heterologous sequence at that new site.

"Homology" or "identity" or "similarity" refers to sequence similarity between two peptides or between two nucleic acid molecules. Homology can be determined by comparing a position in each sequence which may be aligned for purposes of comparison. When a position in the compared sequence is occupied by the same nucleobase or amino acid, then the molecules are homologous at that position. A degree of homology between sequences is a function of the number of matching or homologous positions shared by the sequences. A polynucleotide or polynucleotide region (or a polypeptide or polypeptide region) has a certain percentage (for example, at least 60%, 65%, 70%, 75%, 80%, 85%, 90%, 95%, 98% or 99%) of "sequence identity" to another sequence means that, when aligned, that percentage of bases (or amino acids) are the same in comparing the two sequences. This alignment and the percent homology or sequence identity can be determined using software programs known in the art. In some embodiments, default parameters are used for alignment. One alignment program is BLAST, using default parameters. In particular, programs are BLASTN and BLASTP, using the following default parameters: Genetic code=standard; filter=none; strand=both; cutoff=60; expect=10; Matrix=BLOSUM62; Descriptions=50 sequences; sort by =HIGH SCORE; Databases=non-redundant, GenBank+EMBL+DDBJ+ PDB+GenBank CDS translations+SwissProtein+SPupdate+ PIR. Details of these programs can be found at the National Center for Biotechnology Information. Biologically equivalent polynucleotides are those having the specified percent homology and encoding a polypeptide having the same or similar biological activity. Two sequences are deemed "unrelated" or "non-homologous" if they share less than 40% identity, or less than 25% identity, with each other.

As used herein, a "host cell" is a bacterial cell that can be infected by a phage to yield progeny phage particles. A host cell can form phage particles from a particular type of phage genomic DNA. In some embodiments, the phage genomic DNA is introduced into the host cell by infecting the host cell with a phage. In some embodiments, the phage genomic DNA is introduced into the host cell using transformation, electroporation, or any other suitable technique. In some embodiments, the phage genomic DNA is substantially pure when introduced into the host cell. In some embodiments, the phage genomic DNA is present in a vector when introduced into the host cell. The definition of host cell can vary from one phage to another. For example, *E. coli* may be the natural host cell for a particular type of phage, but *Klebsiella pneumoniae* is not.

As used herein, the term "isolated" refers to a substance or entity that has been separated from at least some of the components with which it was associated when initially produced (whether in nature or in an experimental setting). Isolated substances and/or entities may be separated from at least about 10%, about 20%, about 30%, about 40%, about 50%, about 60%, about 70%, about 80%, about 90%, or more of the other components with which they were initially associated. In some embodiments, isolated substances and/or entities are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components.

As used herein, "operably linked" means that expression control sequences are positioned relative to a nucleic acid of interest to initiate, regulate or otherwise control transcription of the nucleic acid of interest.

As used herein, a "phage genome" or "bacteriophage genome" includes naturally occurring phage genomes and derivatives thereof. Generally, the derivatives possess the ability to propagate in the same hosts as the naturally occurring phage. In some embodiments, the only difference between a naturally occurring phage genome and a derivative phage genome is at least one of a deletion or an addition of nucleotides from at least one end of the phage genome (if the genome is linear) or at least one point in the genome (if the genome is circular).

As used herein, the term "polynucleotide" or "nucleic acid" means any RNA or DNA, which may be unmodified or modified RNA or DNA. Polynucleotides include, without limitation, single- and double-stranded DNA, DNA that is a mixture of single- and double-stranded regions, single- and double-stranded RNA, RNA that is mixture of single- and double-stranded regions, and hybrid molecules comprising DNA and RNA that may be single-stranded or, more typically, double-stranded or a mixture of single- and double-stranded regions. In addition, polynucleotide refers to triple-stranded regions comprising RNA or DNA or both RNA and DNA. The term polynucleotide also includes DNAs or RNAs containing one or more modified bases and DNAs or RNAs with backbones modified for stability or for other reasons.

As used herein, the term "recombinant" when used with reference, e.g., to a cell, or nucleic acid, protein, or vector, indicates that the cell, nucleic acid, protein or vector, has been modified by the introduction of a heterologous nucleic acid or protein or the alteration of a native nucleic acid or protein, or that the material is derived from a cell so modified. Thus, for example, recombinant cells express genes that are not found within the native (non-recombinant) form of the cell or express native genes that are otherwise abnormally expressed, under expressed or not expressed at all.

As used herein, an endogenous nucleic acid sequence in the genome of an organism (or the encoded protein product of that sequence) is deemed "recombinant" herein if a heterologous sequence is placed adjacent to the endogenous nucleic acid sequence, such that the expression of this endogenous nucleic acid sequence is altered. In this context, a heterologous sequence is a sequence that is not naturally adjacent to the endogenous nucleic acid sequence, whether or not the heterologous sequence is itself endogenous to the organism (originating from the same organism or progeny thereof) or exogenous (originating from a different organism or progeny thereof). By way of example, a promoter sequence can be substituted (e.g., by homologous recombination) for the native promoter of a gene in the genome of an organism, such that this gene has an altered expression pattern. This gene would be "recombinant" because it is separated from at least some of the sequences that naturally flank it. A nucleic acid is also considered "recombinant" if it contains any modifications that do not naturally occur in the corresponding nucleic acid in a genome. For instance, an endogenous coding sequence is considered "recombinant" if it contains an insertion, deletion or a point mutation introduced artificially, e.g., by human intervention. A "recombinant nucleic acid" also includes a nucleic acid integrated into a host cell chromosome at a heterologous site and a nucleic acid construct present as an episome.

As used herein, a "recombinant bacteriophage genome" is a bacteriophage genome that has been genetically modified by the insertion of a heterologous nucleic acid sequence into the bacteriophage genome. A "recombinant bacteriophage" means a bacteriophage that comprises a recombinant bacteriophage genome. In some embodiments, the bacteriophage genome is modified by recombinant DNA technology to introduce a heterologous nucleic acid sequence into the genome at a defined site. In some embodiments, the heterologous nucleic acid sequence is introduced with no corresponding loss of endogenous phage genomic nucleotides. In other words, if bases N1 and N2 are adjacent in the wild-type bacteriophage genome, the heterologous nucleic acid sequence is inserted between N1 and N2. Thus, in the resulting recombinant bacteriophage genome, the heterologous nucleic acid sequence is flanked by nucleotides N1 and N2. In some embodiments, endogenous phage nucleotides are removed or replaced during the insertion of the heterologous nucleic acid sequence. For example, in some embodiments, the heterologous nucleic acid sequence is inserted in place of some or all of the endogenous phage sequence which is removed. In some embodiments, endogenous phage sequences are removed from a position in the phage genome distant from the site(s) of insertion of the heterologous nucleic acid sequences.

As used herein, a "recombinant K or 812 bacteriophage" or "recombinant K or 812 phage" means a K or 812 bacteriophage whose genomic DNA comprises a heterologous nucleic acid sequence that encodes a bioluminescent protein, a fluorescent protein, a chromogenic protein, or any combination thereof.

As used herein, the term "sample" refers to clinical samples obtained from a subject or isolated microorganisms. In certain embodiments, a sample is obtained from a biological source (i.e., a "biological sample"), such as tissue, bodily fluid, or microorganisms collected from a subject. Sample sources include, but are not limited to, mucus, sputum, bronchial alveolar lavage (BAL), bronchial wash (BW), whole blood, bodily fluids, cerebrospinal fluid (CSF), urine, plasma, serum, or tissue.

As used herein, "a sub-sample" refers to one or more samples containing bacterial cells that are derived from a test sample obtained from a subject. In some embodiments, the sub-sample is void of non-bacterial cells (e.g., human cells). In some embodiments, the sub-sample contains lysed human cells.

As used herein, "test sample" refers to a sample taken from a subject that is to be assayed for the presence of bacteria and/or for the antibiotic susceptibility of bacteria present in the sample. In some embodiments, the test sample is blood, sputum, mucus, lavage, urine, or saliva. In certain embodiments, the test sample is a swab from a subject.

As used herein, the terms "subject," "individual," or "patient" are used interchangeably and refer to an individual organism, a vertebrate, a mammal, or a human. In certain embodiments, the individual, patient or subject is a human.

As used herein, a "vector" refers to a nucleic acid molecule capable of transporting another nucleic acid to which it has been linked. One type of vector is a "plasmid," which generally refers to a circular double stranded DNA loop into which additional DNA segments may be ligated, but also includes linear double-stranded molecules such as those resulting from amplification by the polymerase chain reaction (PCR) or from treatment of a circular plasmid with a restriction enzyme. Other vectors include cosmids, bacterial artificial chromosomes (BAC) and yeast artificial chromosomes (YAC). Another type of vector is a viral vector, wherein additional DNA segments may be ligated into the viral genome (discussed in more detail below). Certain vectors are capable of autonomous replication in a host cell into which they are introduced (e.g., vectors having an origin of replication which functions in the host cell). Other vectors can be integrated into the genome of a host cell upon introduction into the host cell, and are thereby replicated along with the host genome. Moreover, certain vectors are capable of directing the expression of genes to which they are operatively linked. Such vectors are referred to herein as "recombinant expression vectors" (or simply "expression vectors").

Bacteriophage

Bacteriophage are obligate intracellular parasites that multiply inside bacteria by co-opting some or all of the host biosynthetic machinery. Phages contain nucleic acid and protein, and may be enveloped by a lipid membrane. Depending upon the phage, the nucleic acid genome can be either DNA or RNA but not both, and can exist in either circular or linear forms. The size of the phage genome varies depending upon the phage. The simplest phages have genomes that are only a few thousand nucleotides in size, while the more complex phages may contain more than 100,000 nucleotides in their genome, and in rare instances no more than 500,000 bp. The number and amount of individual types of protein in phage particles will vary depending upon the phage. The proteins function in infection and to protect the nucleic acid genome from environmental nucleases.

Phage genomes come in a variety of sizes and shapes (e.g., linear or circular). Most phages range in size from 24-200 nm in diameter. The capsid is composed of many copies of one or more phage proteins, and acts as a protective envelope around the phage genome. Many phages have tails attached to the phage capsid. The tail is a hollow tube through which the phage nucleic acid passes during infection. The size of the tail can vary and some phages do not even have a tail structure. In the more complex phages, the tail is surrounded by a contractile sheath which contracts during infection of the bacterial host cell. At the end of the tail, phages have a base plate and one or more tail fibers attached to it. The base plate and tail fibers are involved in the binding of the phage to the host cell.

Lytic or virulent phages are phages which can only multiply in bacteria and lyse the bacterial host cell at the end of the life cycle of the phage. The lifecycle of a lytic phage begins with an eclipse period. During the eclipse phase, no infectious phage particles can be found either inside or outside the host cell. The phage nucleic acid takes over the host biosynthetic machinery and phage specific mRNAs and proteins are produced. Early phage mRNAs code for early proteins that are needed for phage DNA synthesis and for shutting off host DNA, RNA and protein biosynthesis. In some cases, the early proteins actually degrade the host chromosome. After phage DNA is made late mRNAs and late proteins are made. The late proteins are the structural proteins that comprise the phage as well as the proteins needed for lysis of the bacterial cell. In the next phase, the phage nucleic acid and structural proteins are assembled and infectious phage particles accumulate within the cell. The bacteria begin to lyse due to the accumulation of the phage lysis protein, leading to the release of intracellular phage particles. The number of particles released per infected cell can be as high as 1000 or more. Lytic phage may be enumerated by a plaque assay. The assay is performed at a low enough concentration of phage such that each plaque arises from a single infectious phage. The infectious particle that gives rise to a plaque is called a PFU (plaque forming unit).

Lysogenic phages are those that can either multiply via the lytic cycle or enter a quiescent state in the host cell. In the quiescent state, the phage genome exists as a prophage (i.e., it has the potential to produce phage). In most cases, the phage DNA actually integrates into the host chromosome and is replicated along with the host chromosome and passed on to the daughter cells. The host cell harboring a prophage is not adversely affected by the presence of the prophage and the lysogenic state may persist indefinitely. The lysogenic state can be terminated upon exposure to adverse conditions. Conditions which favor the termination of the lysogenic state include: desiccation, exposure to UV or ionizing radiation, exposure to mutagenic chemicals, etc. Adverse conditions lead to the production of proteases (rec A protein), the expression of the phage genes, reversal of the integration process, and lytic multiplication.

Recombinant K or 812 Phage Compositions of the Present Technology

The K bacteriophage has a genome size of 127,395 bps (see FIG. 17; SEQ ID NO: 1) and the 812 bacteriophage has a genome size of 142,096 bps (see FIG. 15; SEQ ID NO: 2). In one aspect, the present disclosure provides a recombinant K bacteriophage nucleic acid sequence, wherein the nucleic acid sequence between position 70,285 and 71,657 of SEQ ID NO: 1 is replaced with a heterologous nucleic acid sequence comprising an open reading frame that encodes a reporter protein, wherein the reporter protein is a bioluminescent protein, a fluorescent protein, a chemiluminescent protein, or any combination thereof. In some embodiments, the heterologous nucleic acid sequence further comprises at least one segment that corresponds to at least part of the excised endogenous phage genome sequence between position 70,285 and 71,657 of SEQ ID NO: 1.

In another aspect, the present disclosure provides a recombinant 812 bacteriophage nucleic acid sequence, wherein the nucleic acid sequence between position 79,551 and 80,923 of SEQ ID NO: 2 is replaced with a heterologous nucleic acid sequence comprising an open reading frame that encodes a reporter protein, wherein the reporter protein is a bioluminescent protein, a fluorescent protein, a chemiluminescent protein, or any combination thereof. In some embodiments, the heterologous nucleic acid sequence further comprises at least one segment that corresponds to at least part of the excised endogenous phage genome sequence between position 79,551 and 80,923 of SEQ ID NO: 2.

Also disclosed herein are recombinant K or 812 bacteriophages that comprise any recombinant K or 812 bacteriophage nucleic acid sequence disclosed herein. In some embodiments, the reporter protein(s) encoded by the heterologous nucleic acid sequence produces a detectable signal upon exposure to the appropriate stimuli, and the resulting signal permits detection of bacterial host cells infected by a recombinant K or 812 phage of the present technology.

In certain embodiments, the open reading frame encodes a reporter protein that serves as a marker that can be identified by screening bacterial host cells infected by a recombinant K or 812 phage of the present technology. Examples of such markers include by way of example and without limitation: a fluorescent label, a luminescent label, a chemiluminescence label, or an enzymatic label. In some embodiments, the heterologous nucleic acid sequence further comprises sequences naturally found in the bacteriophage, but placed at a non-normally occurring location in the genome.

In some embodiments, the length of the heterologous nucleic acid sequence is at least 100 bases, at least 200 bases, at least 300 bases, at least 400 bases, at least 500 bases, at least 600 bases, at least 700 bases, at least 800 bases, at least 900 bases, at least 1 kilobase (kb), at least 1.1 kb, at least 1.2 kb, at least 1.3 kb, at least 1.4 kb, at least 1.5 kb, at least 1.6 kb, at least 1.7 kb, at least 1.8 kb, at least 1.9 kb, at least 2.0 kb, at least 2.1 kb, at least 2.2 kb, at least 2.3 kb, at least 2.4 kb, at least 2.5 kb, at least 2.6 kb, at least 2.7 kb, at least 2.8 kb, at least 2.9 kb, at least 3.0 kb, at least 3.1 kb, at least 3.2 kb, at least 3.3 kb, at least 3.4 kb, at least 3.5 kb, at least 3.6 kb, at least 3.7 kb, at least 3.8 kb, at least 3.9 kb, at least 4.0 kb, at least 4.5 kb, at least 5.0 kb, at least 5.5 kb, at least 6.0 kb, at least 6.5 kb, at least 7.0 kb, at least 7.5 kb, at least 8.0 kb, at least 8.5 kb, at least 9.0 kb, at least 9.5 kb, at least 10 kb, or more. In certain embodiments, the heterologous nucleic acid sequence comprises a length that is less than or equal to a length selected from the group consisting of 1 kb, 2 kb, 3 kb, 4 kb, 5 kb, 6 kb, 7 kb, 8 kb, 9 kb, and 10 kb. In some embodiments, the heterologous nucleic acid sequence comprises a length that is less than or equal to the maximum length of heterologous nucleic acid sequence that can be packaged into a phage particle comprising the phage genome.

In some embodiments, the length of the heterologous nucleic acid sequence is from 100 to 500 bases, from 200 to 1,000 bases, from 500 to 1,000 bases, from 500 to 1,500 bases, from 1 kb to 2 kb, from 1.5 kb to 2.5 kb, from 2.0 kb to 3.0 kb, from 2.5 kb to 3.5 kb, from 3.0 kb to 4.0 kb, from 3.5 kb to 4.5 kb, from 4.0 kb to 5.0 kb, from 4.5 kb to 5.5 kb, from 5.0 kb to 6.0 kb, from 5.5 kb to 6.5 kb, from 6.0 kb to 7.0 kb, from 6.5 kb to 7.5 kb, from 7.0 kb to 8.0 kb, from 7.5 kb to 8.5 kb, from 8.0 kb to 9.0 kb, from 8.5 kb to 9.5 kb, or from 9.0 kb to 10.0 kb.

In some embodiments, the heterologous nucleic acid sequence is inserted into the K or 812 phage genome with no loss of endogenous K or 812 phage genomic sequence. In some embodiments, the heterologous nucleic acid sequence replaces an endogenous K or 812 phage genomic sequence. In some embodiments, the heterologous nucleic acid sequence includes an endogenous K or 812 phage genomic sequence that was previously excised from the phage genome.

In certain embodiments, the heterologous nucleic acid sequence replaces an endogenous K or 812 phage genomic sequence that is less than the length of the heterologous nucleic acid sequence. Accordingly, in some embodiments, the length of the recombinant K or 812 phage genome is longer than the length of the wild-type K or 812 phage genome. In some embodiments, the heterologous nucleic acid sequence replaces an endogenous K or 812 phage genomic sequence that is greater than the length of the heterologous nucleic acid sequence. Thus, in some embodiments, the length of the recombinant K or 812 phage genome is shorter than the length of the wild-type K or 812 phage genome. In certain embodiments, the heterologous nucleic acid sequence replaces an endogenous K or 812 phage genomic sequence that is equal to the length of the heterologous nucleic acid sequence.

In certain embodiments, the open reading frame of the heterologous nucleic acid sequence encodes a reporter protein that confers a phenotype of interest on a host cell infected by a recombinant K or 812 phage of the present technology. In some embodiments, the phenotype of interest is the expression of the gene product encoded by the open reading frame of the heterologous nucleic acid sequence.

In certain embodiments, the open reading frame of the heterologous nucleic acid sequence is operably linked to an expression control sequence that is capable of directing expression of the open reading frame, wherein the open reading frame encodes a reporter protein (e.g., a bioluminescent protein, a fluorescent protein, a chemiluminescent protein, or any combination thereof). In some embodiments, the expression control sequence is located within the heterologous nucleic acid sequence. In other embodiments, the expression control sequence is located in the endogenous K or 812 phage genome sequence. For example, the open reading frame may be inserted into the K or 812 phage genome downstream of or in the place of an endogenous K or 812 phage open reading frame sequence. In some embodiments, the expression control sequence is an inducible promoter or a constitutive promoter (e.g., sarA promoter or lpp promoter). See e.g., Djordjevic & Klaenhammer, *Methods in Cell Science* 20(1):119-126 (1998). The inducible promoter or constitutive promoter may be an endogenous K or 812 phage promoter sequence, a phage promoter sequence that is non-endogenous to K or 812 phage, or a bacterial host promoter sequence. Additionally or alternatively, in some embodiments, the inducible promoter is a pH-sensitive promoter, or a temperature sensitive promoter.

In some embodiments, the heterologous nucleic acid sequence comprises a first open reading frame and at least one supplemental open reading frame. In certain embodiments, the first and the at least one supplemental open reading frames are operably linked to the same expression control sequences. In some embodiments, the first and the at least one supplemental open reading frames are operably linked to different expression control sequences.

Fluorescent proteins include, but are not limited to, blue/UV fluorescent proteins (for example, TagBFP, Azurite, EBFP2, mKalama1, Sirius, Sapphire, and T-Sapphire), cyan fluorescent proteins (for example, ECFP, Cerulean, SCFP3A, mTurquoise, monomeric Midoriishi-Cyan, TagCFP, and mTFP1), green fluorescent proteins (for example, EGFP, Emerald, Superfolder GFP, Monomeric Azami Green, TagGFP2, mUKG, and mWasabi), yellow fluorescent proteins (for example, EYFP, Citrine, Venus, SYFP2, and TagYFP), orange fluorescent proteins (for example, Monomeric Kusabira-Orange, mKOκ, mKO2, mOrange, and mOrange2), red fluorescent proteins (for example, mRaspberry, mCherry, dsRed, mStrawberry, mTangerine, tdTomato, TagRFP, TagRFP-T, mApple, and mRuby), far-red fluorescent proteins (for example, mPlum, HcRed-Tandem, mKate2, mNeptune, and NirFP), near-IR fluorescent proteins (for example, TagRFP657, IFP1.4, and iRFP), long stokes-shift proteins (for example, mKeima Red, LSS-mKate1, and LSS-mKate2), photoactivatable fluorescent proteins (for example, PA-GFP, PAmCherry1, and PATagRFP), photoconvertible fluorescent proteins (for example, Kaede (green), Kaede (red), KikGR1 (green), KikGR1 (red), PS-CFP2, PS-CFP2, mEos2 (green), mEos2

(red), PSmOrange, and PSmOrange), fluorescein, rhodamine, and photoswitchable fluorescent proteins (for example, Dronpa).

Examples of bioluminescent proteins are aequorin (derived from the jellyfish *Aequorea victoria*) and luciferases (including luciferases derived from firefly and *Renilla*, nano-luciferase, red luciferase, luxAB, and the like). These proteins have also been genetically separated into two distinct functional domains that will generate light only when the protein domains are closely co-localized. A variety of emission spectrum-shifted mutant derivatives of both of these proteins have been generated over the past decade and have been used for multi-color imaging and co-localization within a living cell.

Examples of chemiluminescent protein include β-galactosidase, horseradish peroxidase (HRP), and alkaline phosphatase. Peroxidases generate peroxide that oxidizes luminol in a reaction that generates light, whereas alkaline phosphatases remove a phosphate from a substrate molecule, destabilizing it and initiating a cascade that results in the emission of light.

In some embodiments, the open reading frame of the heterologous nucleic acid sequence comprises an epitope that can be detected with an antibody or other binding molecule. For example, an antibody that recognizes the epitope may be directly linked to a signal generating moiety (such as by covalent attachment of a chemiluminescent or fluorescent protein), or can be detected using at least one additional binding reagent such as a secondary antibody, directly linked to a signal generating moiety. In some embodiments, the epitope is absent in wild-type K or 812 bacteriophage and the bacterial host cell. Accordingly, detection of the epitope in a sample demonstrates the presence of a bacterial host cell infected by a recombinant K or 812 phage comprising a heterologous nucleic acid sequence, wherein the open reading frame of the heterologous nucleic acid sequence comprises the epitope. In other embodiments, the open reading frame of the heterologous nucleic acid sequence comprises a polypeptide tag sequence, such that the expression product of the open reading frame comprises the tag fused to a polypeptide or protein encoded by the open reading frame (e.g., poly-histidine, FLAG, Glutathione S-transferase (GST) etc.).

In some embodiments, the open reading frame of the heterologous nucleic acid sequence comprises a biotin binding protein such as avidin, streptavidin, or neutrAvidin that can be detected with a biotin molecule conjugated to an enzyme (e.g., β-galactosidase, horseradish peroxidase (HRP), and alkaline phosphatase) or an antibody. In some embodiments, an antibody conjugated to a biotin molecule may be directly linked to a signal generating moiety (such as by covalent attachment of a chemiluminescent or fluorescent protein), or can be detected using at least one additional binding reagent such as a secondary antibody, directly linked to a signal generating moiety.

Also disclosed herein are recombinant K or 812 bacteriophages comprising any of the recombinant K or 812 bacteriophage nucleic acid sequences disclosed herein. In some embodiments, the recombinant K or 812 bacteriophages comprise a nucleic acid sequence selected from the group consisting of SEQ ID NO: 5, SEQ ID NO: 6, SEQ ID NO: 7, SEQ ID NO: 8, SEQ ID NO: 9, SEQ ID NO: 14 and SEQ ID NO: 15.

In another aspect, the present disclosure provides a vector comprising any of the recombinant K or 812 bacteriophage nucleic acid sequences disclosed herein, as well as bacterial host cells comprising the vectors of the present technology. The bacterial host cell may be a natural or non-natural host for K or 812 bacteriophage.

The present disclosure also provides a bacterial host cell comprising a recombinant K or 812 bacteriophage disclosed herein. The bacterial host cell may be a natural or non-natural host for K or 812 bacteriophage.

Methods of Making Recombinant K or 812 Bacteriophage of the Present Technology

In one aspect, the present disclosure provides methods for making a recombinant K or 812 bacteriophage in a bacterial host cell comprising (a) recombining in vivo a first K or 812 bacteriophage genome with a heterologous nucleic acid in the presence of a recombination system under conditions to produce a recombinant K or 812 bacteriophage genome, wherein the bacterial host cell is infected with the first K or 812 bacteriophage genome, and wherein the heterologous nucleic acid sequence comprises an open reading frame that encodes a bioluminescent protein, a fluorescent protein, a chemiluminescent protein, or any combination thereof. The first K or 812 bacteriophage genome may be recombinant or non-recombinant.

In some embodiments, the heterologous nucleic acid comprises (a) a 5' flanking region that is homologous to a first region within the first K or 812 bacteriophage genome, and (b) a 3' flanking region that is homologous to a second region within the first K or 812 bacteriophage genome.

Additionally or alternatively, in some embodiments, the method further comprises propagating the recombinant K or 812 bacteriophage genome in a bacterial host. For example, the bacterial host may be transformed with the recombinant K or 812 bacteriophage genome via electroporation. The bacterial host may be a non-natural bacterial host cell or a natural bacterial host cell for K or 812 bacteriophage.

In some embodiments of the methods disclosed herein, the homologous 5' flanking region of the heterologous nucleic acid sequence has a length of about 20-30 base pairs (bps), 30-40 bps, 40-50 bps, 50-60 bps, 60-70 bps, 70-80 bps, 80-90 bps, 90-100 bps, 100-110 bps, 110-120 bps, 120-130 bps, 130-140 bps, 140-150 bps, 150-160 bps, 160-170 bps, 170-180 bps, 180-190 bps, 190-200 bps, 200-210 bps, 210-220 bps, 220-230 bps, 230-240 bps, 240-250 bps, 250-260 bps, 260-270 bps, 270-280 bps, 280-290 bps, 290-300 bps, 300-310 bps, 310-320 bps, 320-330 bps, 330-340 bps, 340-350 bps, 350-360 bps, 360-370 bps, 370-380 bps, 380-390 bps, 390-400 bps, 400-410 bps, 410-420 bps, 420-430 bps, 430-440 bps, 440-450 bps, 450-460 bps, 460-470 bps, 470-480 bps, 480-490 bps, 490-500 bps, 500-510 bps, 510-520 bps, 520-530 bps, 530-540 bps, 540-550 bps, 550-560 bps, 560-570 bps, 570-580 bps, 580-590 bps, or 590-600 bps.

Additionally or alternatively, in some embodiments of the methods disclosed herein, the homologous 3' flanking region of the heterologous nucleic acid sequence has a length of about 20-30 base pairs (bps), 30-40 bps, 40-50 bps, 50-60 bps, 60-70 bps, 70-80 bps, 80-90 bps, 90-100 bps, 100-110 bps, 110-120 bps, 120-130 bps, 130-140 bps, 140-150 bps, 150-160 bps, 160-170 bps, 170-180 bps, 180-190 bps, 190-200 bps, 200-210 bps, 210-220 bps, 220-230 bps, 230-240 bps, 240-250 bps, 250-260 bps, 260-270 bps, 270-280 bps, 280-290 bps, 290-300 bps, 300-310 bps, 310-320 bps, 320-330 bps, 330-340 bps, 340-350 bps, 350-360 bps, 360-370 bps, 370-380 bps, 380-390 bps, 390-400 bps, 400-410 bps, 410-420 bps, 420-430 bps, 430-440 bps, 440-450 bps, 450-460 bps, 460-470 bps, 470-480 bps, 480-490 bps, 490-500 bps, 500-510 bps, 510-520 bps, 520-530 bps, 530-540 bps, 540-550 bps, 550-560 bps, 560-570 bps, 570-580 bps, 580-590 bps, or 590-600 bps.

Additionally or alternatively, in some embodiments of the methods disclosed herein, the recombination system is endogenous to the bacterial host cell. In certain embodiments of the methods disclosed herein, the recombination system is a non-endogenous recombination system that is induced in the bacterial host cell. The non-endogenous recombination system may include a recombination expression vector that comprises lambda Red proteins Gam, Exo, and Beta operably linked to an inducible promoter. In some embodiments of the methods disclosed herein, the inducible promoter is araB and the non-endogenous recombination system is induced by the addition of arabinose. In some embodiments, the recombination expression vector further comprises the heterologous nucleic acid sequence. In other embodiments, the expression vector comprising the heterologous nucleic acid sequence is separate and distinct from the recombination expression vector comprising lambda Red proteins.

In other embodiments of the methods disclosed herein, the recombination system is a non-endogenous recombination system that includes a recombination expression vector comprising RecET (RecE, RecT) operons operably linked to an inducible promoter, and optionally the heterologous nucleic acid sequence. In some embodiments, the inducible promoter is araB and the non-endogenous recombination system is induced by the addition of arabinose. In other embodiments, the expression vector comprising the heterologous nucleic acid sequence is separate and distinct from the recombination expression vector comprising RecET.

In another embodiment of the methods disclosed herein, the recombination system is a non-endogenous recombination system that includes a recombination expression vector comprising RecA recombinase or a RecA gain-of-function variant operably linked to an inducible promoter and optionally the heterologous nucleic acid sequence. In some embodiments, the inducible promoter is araB and the non-endogenous recombination system is induced by the addition of arabinose. In other embodiments, the expression vector comprising the heterologous nucleic acid sequence is separate and distinct from the recombination expression vector comprising RecA recombinase or the RecA gain-of-function variant.

Bacterial Identification and Antibiotic Susceptibility Profiling Methods of the Present Technology Accurate identification of bacterial species within a biological sample informs the selection of suitable therapies for treating bacterial infections. The recombinant K or 812 bacteriophages disclosed herein may be used to identify bacteria present within a biological sample (e.g., whole blood, plasma, serum). Such methods entail contacting the biological sample with a recombinant K or 812 bacteriophage disclosed herein, and detecting the presence of bacterial host cells infected by the recombinant K or 812 phage, wherein the recombinant K or 812 phage comprises a heterologous nucleic acid sequence that encodes a detectable gene product, thereby leading to the identification of bacteria present within the biological sample.

Additionally or alternatively, the recombinant K or 812 bacteriophages disclosed herein, may be used in methods for profiling antibiotic susceptibility of bacteria present within a biological sample (e.g., whole blood, plasma, serum). These methods include (a) infecting the biological sample with an antibiotic and a recombinant K or 812 bacteriophage disclosed herein, (b) detecting the presence of bacterial host cells infected by the recombinant K or 812 phage, wherein the recombinant K or 812 phage comprises a heterologous nucleic acid sequence that encodes a detectable gene product, and (c) determining that the antibiotic is effective in inhibiting the bacteria present in the biological sample when the levels of recombinant K or 812 phage infected bacterial host cells is reduced relative to that observed in an untreated control sample.

In one aspect, the present disclosure provides a method for identifying at least one bacterial strain or species in a test sample obtained from a subject comprising (a) separating bacterial cells isolated from the test sample into one or more sub-samples, (b) infecting each sub-sample with at least one recombinant K or 812 bacteriophage disclosed herein, wherein each recombinant K or 812 bacteriophage comprises a heterologous nucleic acid sequence encoding one or more reporter genes, and (c) identifying at least one bacterial strain or species in the test sample by detecting the expression of the one or more reporter genes of the at least one recombinant K or 812 bacteriophage. In certain embodiments, the at least one K or 812 bacteriophage comprises a nucleic acid sequence selected from the group consisting of SEQ ID NO: 5, SEQ ID NO: 6, SEQ ID NO: 7, SEQ ID NO: 8, SEQ ID NO: 9, SEQ ID NO: 14 and SEQ ID NO: 15. In certain embodiments, the method for identifying at least one bacterial strain or species in a test sample does not require the culturing of bacterial cells from the test sample or a sub-sample.

In some embodiments, identification of at least one bacterial strain or species includes detecting the expression of the one or more reporter genes of the at least one recombinant K or 812 bacteriophage, e.g., detectable expression of green fluorescence indicates the presence of bacterial species A in a test sample or sub-sample. In some embodiments, the absence of at least one bacterial strain or species is identified by the lack of detectable expression of the one or more reporter genes of the at least one recombinant K or 812 bacteriophage, e.g., undetectable expression of green fluorescence indicates the lack of bacterial species A in a test sample or sub-sample.

In some embodiments, the at least one recombinant K or 812 bacteriophage infects a single species of bacteria. In certain embodiments, the at least one recombinant K or 812 bacteriophage infects two or more species of bacteria.

In some embodiments, detection of the expression of the reporter gene is detection of the gene product itself, e.g., a fluorescent protein. In some embodiments, detection of the expression of the reporter gene is detection of an enzymatic reaction requiring the expression of the reporter gene, e.g., expression of luciferase to catalyze luciferin to produce light.

In some embodiments, the expression of the one or more reporter genes is detected in about 5, 10, 15, 20, 25, 30, 35, 40, 45, 50, 55, 60, 65, 70, 75, 80, 85, 90, 120 minutes or any time between any two of the preceding values after infecting a sub-sample with the at least one recombinant K or 812 bacteriophage disclosed herein.

The present disclosure also provides a method for identifying at least one bacterial strain or species in a test sample obtained from a subject comprising (a) infecting the test sample comprising bacterial cells with a recombinant K or 812 bacteriophage of the present technology; and (b) detecting the expression of the reporter protein of the recombinant K or 812 bacteriophage, wherein detection of the reporter protein indicates the presence of at least one bacterial strain or species in the test sample. In some embodiments of the method, the expression of the reporter protein is measured in about 5, 10, 15, 20, 25, 30, 35, 40, 45, 50, 55, 60, 65, 70, 75, 80, 85, 90, or 120 minutes after infecting the test sample comprising bacterial cells with the recombinant K or 812 bacteriophage.

Additionally or alternatively, in some embodiments of the methods disclosed herein, the test sample is blood, sputum, mucus, lavage, saliva, or a swab obtained from the subject. In some embodiments, the subject is human.

In another aspect, the present disclosure provides a method for determining the antibiotic susceptibility of a bacterial strain or species in a test sample obtained from a subject comprising (a) separating bacterial cells isolated from the test sample into a plurality of sub-samples, (b) infecting the plurality of sub-samples with a recombinant K or 812 bacteriophage disclosed herein and at least one antibiotic, wherein the recombinant K or 812 bacteriophage comprises a heterologous nucleic acid sequence encoding a reporter gene, and (c) detecting the expression of the reporter gene of the recombinant K or 812 bacteriophage in the presence of each antibiotic. In some embodiments, the method further comprises determining that the bacterial strain or species in the test sample is susceptible to an antibiotic if the reporter gene expression of the recombinant K or 812 bacteriophage in the antibiotic treated sub-sample is decreased relative to that observed in a control sub-sample that is not treated with the antibiotic. In other embodiments, the method further comprises determining that the bacterial strain or species in the test sample is resistant to an antibiotic if the reporter gene expression of the recombinant K or 812 bacteriophage in the antibiotic treated sub-sample is comparable to that observed in a control sub-sample that is not treated with the antibiotic. In certain embodiments, the method for determining the antibiotic susceptibility of a bacterial strain or species in a test sample does not require the culturing of bacterial cells from a test sample or a sub-sample.

Additionally or alternatively, in some embodiments of the recombinant K or 812 bacteriophages of the present technology, the reporter gene is nanoluciferase. In certain embodiments, recombinant K or 812 bacteriophage comprises a nucleic acid sequence selected from the group consisting of SEQ ID NO: 5, SEQ ID NO: 6, SEQ ID NO: 7, SEQ ID NO: 8, SEQ ID NO: 9, SEQ ID NO: 14 and SEQ ID NO: 15.

Examples of antibiotics include one or more of rifampicin, tetracycline, levofloxacin, ampicillin, penicillin G, methicillin, oxacillin, amoxicillin, cefadroxil, ceforanid, cefotaxime, ceftriaxone, doxycycline, minocycline, amikacin, gentamicin, levofloxacin, kanamycin, neomycin, streptomycin, tobramycin, azithromycin, clarithromycin, erythromycin, ciprofloxacin, lomefloxacin, norfloxacin, chloramphenicol, clindamycin, cycloserine, isoniazid, rifampin, teicoplanin, quinupristin/dalfopristin, linezolid, pristinamycin, ceftobiprole, ceftaroline, dalbavancin, daptomycin, mupirocin, oritavancin, tedizolid, telavancin, tigecycline, ceftazidime, cefepime, piperacillin, ticarcillin, virginiamycin, netilmicin, paromomycin, spectinomycin, geldanamycin, herbimycin, rifaximin, loracarbef, ertapenem, doripenem, imipenem/cilastatin, meropenem, cefazolin, cefalotin, cephalexin, cefaclor, cefamandole, cefoxitin, cefprozil, cefuroxime, cefixime, cefdinir, cefditoren, cefoperazone, cefpodoxime, ceftibuten, ceftizoxime, lincomycin, dirithromycin, roxithromycin, troleandomycin, telithromycin, spiramycin, aztreonam, furazolidone, nitrofurantoin, posizolid, radezolid, torezolid, azlocillin, carbenicillin, cloxacillin, dicloxacillin, flucloxacillin, mezlocillin, nafcillin, penicillin V, temocillin, bacitracin, colistin, polymyxin B, enoxacin, gatifloxacin, gemifloxacin, moxifloxacin, nalidixic acid, ofloxacin, trovafloxacin, grepafloxacin, sparfloxacin, temafloxacin, mafenide, sulfacetamide, sulfadiazine, silver sulfadiazine, sulfadimethoxine, sulfamethizole, sulfamethoxazole, sulfanilimide, sulfasalazine, sulfisoxazole, trimethoprim-sulfamethoxazole (Co-trimoxazole) (TMP-SMX), sulfonamidochrysoidine, demeclocycline, oxytetracycline, clofazimine, dapsone, capreomycin, ethambutol, ethionamide, pyrazinamide, rifabutin, rifapentine, arsphenamine, fosfomycin, fusidic acid, metronidazole, platensimycin, thiamphenicol, tinidazole, trimethoprim(Bs) and vancomycin.

In some embodiments of the method, the differences in the reporter gene expression of the recombinant K or 812 bacteriophage observed in the antibiotic treated sub-sample and the untreated control sub-sample is defined as $\mu$.

Additionally or alternatively, in some embodiments of the method, the expression of the reporter gene is detected in about 5, 10, 15, 20, 25, 30, 35, 40, 45, 50, 55, 60, 65, 70, 75, 80, 85, 90, 120 minutes or any time between any two of the preceding values after infecting a sub-sample with a recombinant K or 812 bacteriophage disclosed herein.

In some embodiments, two or more sub-samples are tested for antibiotic susceptibility in series. In some embodiments, two or more sub-samples are tested for antibiotic susceptibility in parallel. In some embodiments, one or more sub-samples are tested for antibiotic susceptibility in a running assay (where resistance or sensitivity to one antibiotic is determined and the resistance or sensitivity to a second, third, fourth, fifth, etc., antibiotic is being assayed).

In some embodiments of the methods disclosed herein, isolating bacterial cells from a test sample includes incubating the test sample with distilled water to form a mixture, centrifuging the mixture to form a pellet that includes bacterial cells, and re-suspending the pellet to form a bacterial suspension comprising isolated bacterial cells after discarding the supernatant. The pellet may be re-suspended in a phosphate buffer. In some embodiments, the bacterial suspension is divided into one or more sub-samples.

In certain embodiments of the methods disclosed herein, mixing the test sample with distilled water will lead to the lysis of cells that lack cell walls (e.g., mammalian cells and red blood cells) while leaving cells with cell walls (e.g., bacteria) intact. Without wishing to be bound by theory, in some embodiments, the removal of cells that lack cell walls enhances the detection of reporter gene expression in bacterial cells infected with a recombinant K or 812 bacteriophage, as intact non-bacterial cells (e.g., red blood cells) may quench reporter gene expression. In some embodiments of the methods of the present technology, the mixture is about 90% distilled water and 10% test sample, about 80% distilled water and 20% test sample, about 70% distilled water and 30% test sample, about 60% distilled water and 40% test sample, about 50% distilled water and 50% test sample, about 40% distilled water and 60% test sample, about 30% distilled water and 70% test sample, about 20% distilled water and 80% sample, or about 10% distilled water and 90% test sample. In some embodiments of the methods disclosed herein, the mixture is incubated for 1, 2, 3, 4, 5, 6, 7, 8, 9, 10, 11, 12, 13, 14, or 15 minutes, or any time between two of the previously listed time points. Additionally or alternatively, in certain embodiments of the methods disclosed herein, the mixture is centrifuged for 1, 2, 3, 4, 5, 6, 7, 8, 9, 10, 11, 12, 13, 14, or 15 minutes, or any time between two of the previously listed time points.

Additionally or alternatively, in certain embodiments of the methods disclosed herein, each of the one or more sub-samples comprise between about 5 to 500, about 10 to 400, about 20 to 300, about 30 to 300, about 40 to 200 or about 50 to 100 bacterial cells. In some embodiments of the methods disclosed herein, each of the one or more sub-samples comprises between about 100 to 10,000, about 200 to 9,000, about 300 to 8,000, about 400 to 7,000, about 500 to 6,000, about 600 to 5,000, about 700 to 4,000, about 800 to 3,000, about 900 to 2,000, or about 1,000 to 1,500 bacterial cells.

In another aspect, the present disclosure provides a method for determining the antibiotic susceptibility of a bacterial strain or species in a test sample obtained from a subject comprising (a) infecting a plurality of test samples comprising bacterial cells with a recombinant K or 812 bacteriophage of the present technology and an antibiotic, wherein the plurality of test samples is derived from the subject; (b) detecting the expression of the reporter protein of the recombinant K or 812 bacteriophage in the plurality of test samples; and (c) determining that the antibiotic is effective in inhibiting the bacterial strain or species in a test sample when the reporter protein expression levels of the recombinant K or 812 phage infected bacterial cells in the test sample are reduced relative to that observed in an untreated control sample comprising recombinant K or 812 phage infected bacterial cells, wherein the untreated control sample is derived from the subject and is infected with the recombinant K or 812 bacteriophage of the present technology. The expression of the reporter protein may be measured in about 5, 10, 15, 20, 25, 30, 35, 40, 45, 50, 55, 60, 65, 70, 75, 80, 85, 90 or 120 minutes after infecting the plurality of test samples comprising bacterial cells with the recombinant K or 812 bacteriophage. In other embodiments, the method further comprises determining that the bacterial strain or species in the test sample is resistant to the antibiotic when the reporter protein expression levels of the recombinant K or 812 bacteriophage infected bacterial cells in the test sample are comparable to that observed in an untreated control sample comprising recombinant K or 812 phage infected bacterial cells, wherein the untreated control sample is derived from the subject and is infected with the recombinant K or 812 bacteriophage of the present technology.

In any of the above embodiments of the methods of the present technology, the test sample is blood, sputum, mucus, lavage, saliva, or a swab obtained from the subject. In some embodiments of the methods disclosed herein, the test sample is obtained from a mammalian subject, including, for example, farm animals, such as sheep, pigs, cows, and horses; pet animals, such as dogs and cats; and laboratory animals, such as rats, mice and rabbits. In one embodiment, the mammal subject is a human.

Kits

The present technology provides kits including the recombinant K or 812 bacteriophages disclosed herein for bacteria identification and antibiotic susceptibility profiling.

In one aspect, the kits of the present technology comprise one or more coded/labeled vials that contain a plurality of the recombinant K or 812 bacteriophages disclosed herein, and instructions for use. In some embodiments, each coded/labeled vial corresponds to a different recombinant K or 812 bacteriophage. In other embodiments, each coded/labeled vial corresponds to the same recombinant K or 812 bacteriophage. In some embodiments, the kits of the present technology comprise one or more coded/labeled vials that contain at least one recombinant K or 812 bacteriophage comprising a nucleic acid sequence selected from the group consisting of SEQ ID NO: 5, SEQ ID NO: 6, SEQ ID NO: 7, SEQ ID NO: 8, SEQ ID NO: 9, SEQ ID NO: 14 and SEQ ID NO: 15

In some embodiments, each phage vial is assigned a unique code that identifies the bacteriophage in the phage vial, or the types of bacteria that the bacteriophage strain infects. The unique code can be encoded by a machine discernible pattern, such as a bar code, a QR code, an alphanumeric string, or any other pattern that can be discerned by a reader. Each unique code may be shown as, for example, a bar code sticker on a vial or container storing a corresponding phage sample. In some embodiments, the kit is stored under conditions that permit the preservation of the bacteriophage genomes for extended periods, such as under bacteriophage-specific, controlled temperature, moisture, and pH conditions.

Additionally or alternatively, in some embodiments, the kits further comprise vials containing natural or non-natural bacterial host cells. In some embodiments, the bacterial host cells are *Staphylococcus aureus*. In certain embodiments, the bacterial host cells are *Staphylococcus aureus* strain NCTC 9318.

The kits may also comprise instructions for use, software for automated analysis, containers, packages such as packaging intended for commercial sale and the like.

The kit may further comprise one or more of: wash buffers and/or reagents, hybridization buffers and/or reagents, labeling buffers and/or reagents, and detection means. The buffers and/or reagents are usually optimized for the particular detection technique for which the kit is intended. Protocols for using these buffers and reagents for performing different steps of the procedure may also be included in the kit. Further optional components of the kits may include expression media for gene products encoded by the heterologous nucleic acids of the recombinant K or 812 bacteriophages disclosed herein, such as a medium containing nutrients and cofactors for bioluminescence, devices such as a lamp configured to illuminate at specific wavelengths of light to detect biofluorescence, and devices for measuring the extent of heterologous nucleic acid expression, such as a photometer or photodetector.

Additionally or alternatively, the kits disclosed herein may also include coded and labeled vials that contain a plurality of antibiotics. In some embodiments, the plurality of antibiotics comprises one or more of rifampicin, tetracycline, levofloxacin, and ampicillin. Other examples of antibiotics include penicillin G, methicillin, oxacillin, amoxicillin, cefadroxil, ceforanid, cefotaxime, ceftriaxone, doxycycline, minocycline, amikacin, gentamicin, levofloxacin, kanamycin, neomycin, streptomycin, tobramycin, azithromycin, clarithromycin, erythromycin, ciprofloxacin, lomefloxacin, norfloxacin, chloramphenicol, clindamycin, cycloserine, isoniazid, rifampin, teicoplanin, quinupristin/dalfopristin, linezolid, pristinamycin, ceftobiprole, ceftaroline, dalbavancin, daptomycin, mupirocin, oritavancin, tedizolid, telavancin, tigecycline, ceftazidime, cefepime, piperacillin, ticarcillin, virginiamycin, netilmicin, paromomycin, spectinomycin, geldanamycin, herbimycin, rifaximin, loracarbef, ertapenem, doripenem, imipenem/cilastatin, meropenem, cefazolin, cefalotin, cephalexin, cefaclor, cefamandole, cefoxitin, cefprozil, cefuroxime, cefixime, cefdinir, cefditoren, cefoperazone, cefpodoxime, ceftibuten, ceftizoxime, lincomycin, dirithromycin, roxithromycin, troleandomycin, telithromycin, spiramycin, aztreonam, furazolidone, nitrofurantoin, posizolid, radezolid, torezolid, azlocillin, carbenicillin, cloxacillin, dicloxacillin, flucloxacillin, mezlocillin, nafcillin, penicillin V, temocillin, bacitracin, colistin, polymyxin B, enoxacin, gatifloxacin, gemifloxacin, moxifloxacin, nalidixic acid, ofloxacin, trovafloxacin, grepafloxacin, sparfloxacin, temafloxacin, mafenide, sulfacetamide, sulfadiazine, silver sulfadiazine, sulfadimethoxine, sulfamethizole, sulfamethoxazole, sulfanilimide, sulfasalazine, sulfisoxazole, trimethoprim-sulfamethoxazole (Co-trimoxazole) (TMP-SMX), sulfonamidochrysoidine, demeclocycline, oxytetracycline, clofazimine, dapsone, capreomycin, ethambutol, ethionamide, pyrazinamide, rifabutin, rifapentine, arsphenamine, fosfomycin, fusidic acid, metronidazole, platensimycin, thiamphenicol, tinidazole, trimethoprim(Bs) and vancomycin.

EXAMPLES

Example 1: Design and Methods for Generating the Recombinant K or 812 Bacteriophages of the Present Technology This Example demonstrates that the methods of the present technology are useful for making the recombinant K or 812 bacteriophages disclosed herein in a bacterial host cell.

Figure 1B:
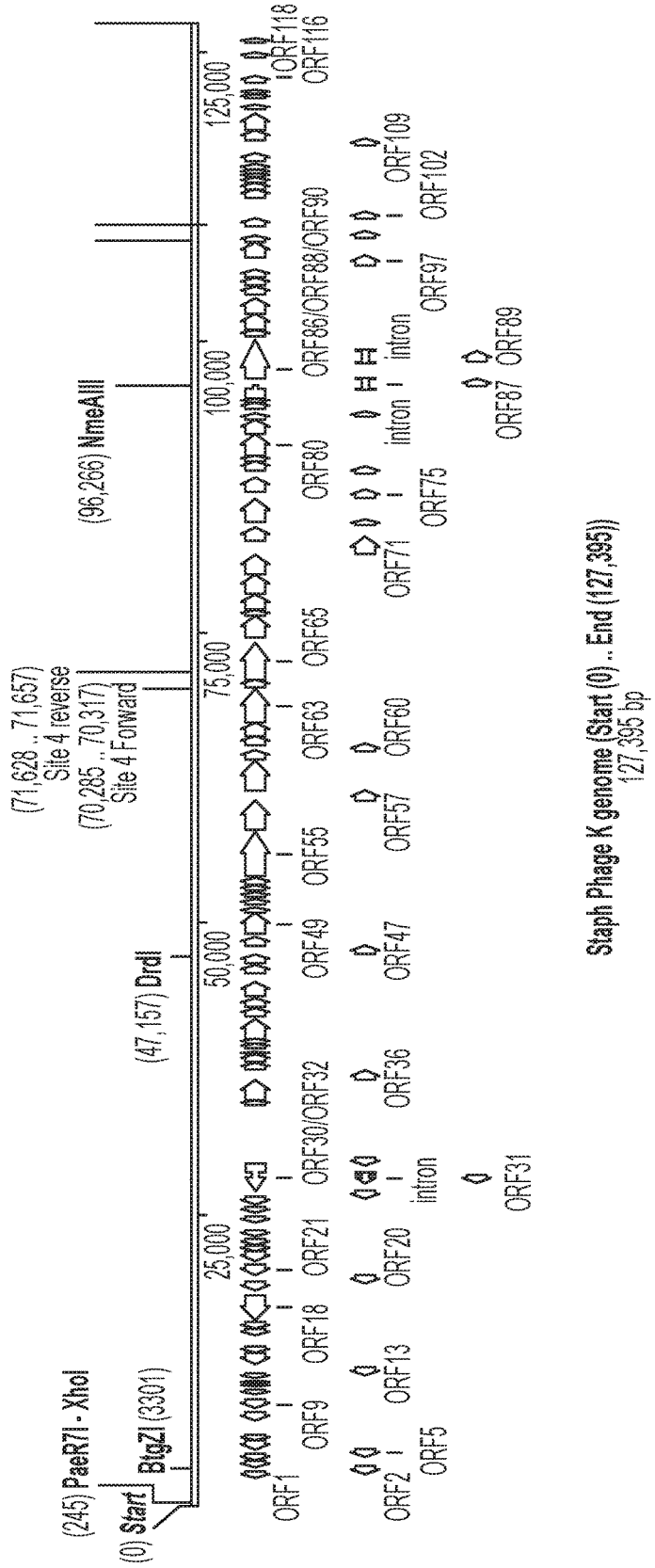
FIG. 1B shows a graphical representation of the K phage genome.
Figure 2A:
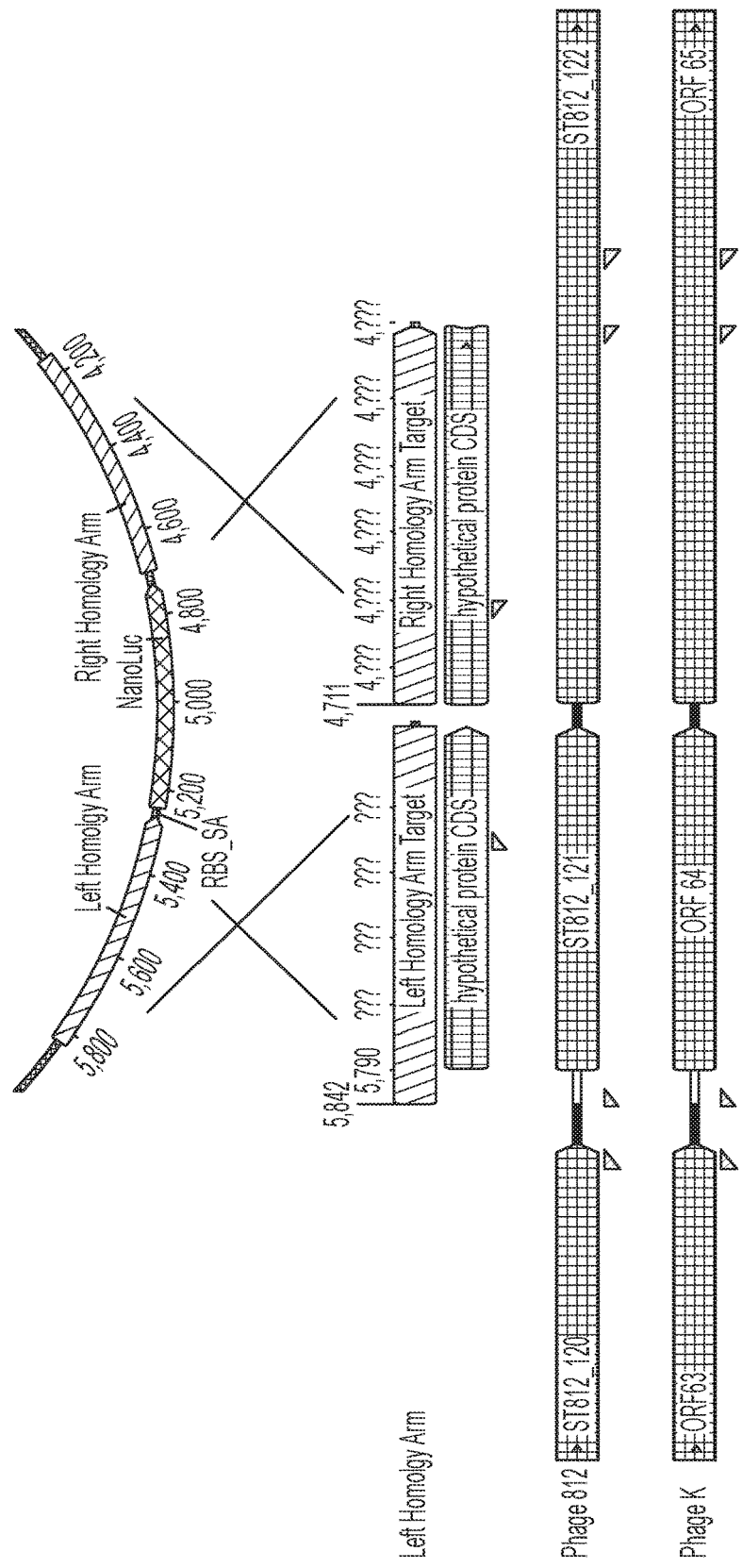
FIG. 2A shows a graphical representation of the recombination between the K or 812 bacteriophage genome and the donor plasmid.
Figure 2B:
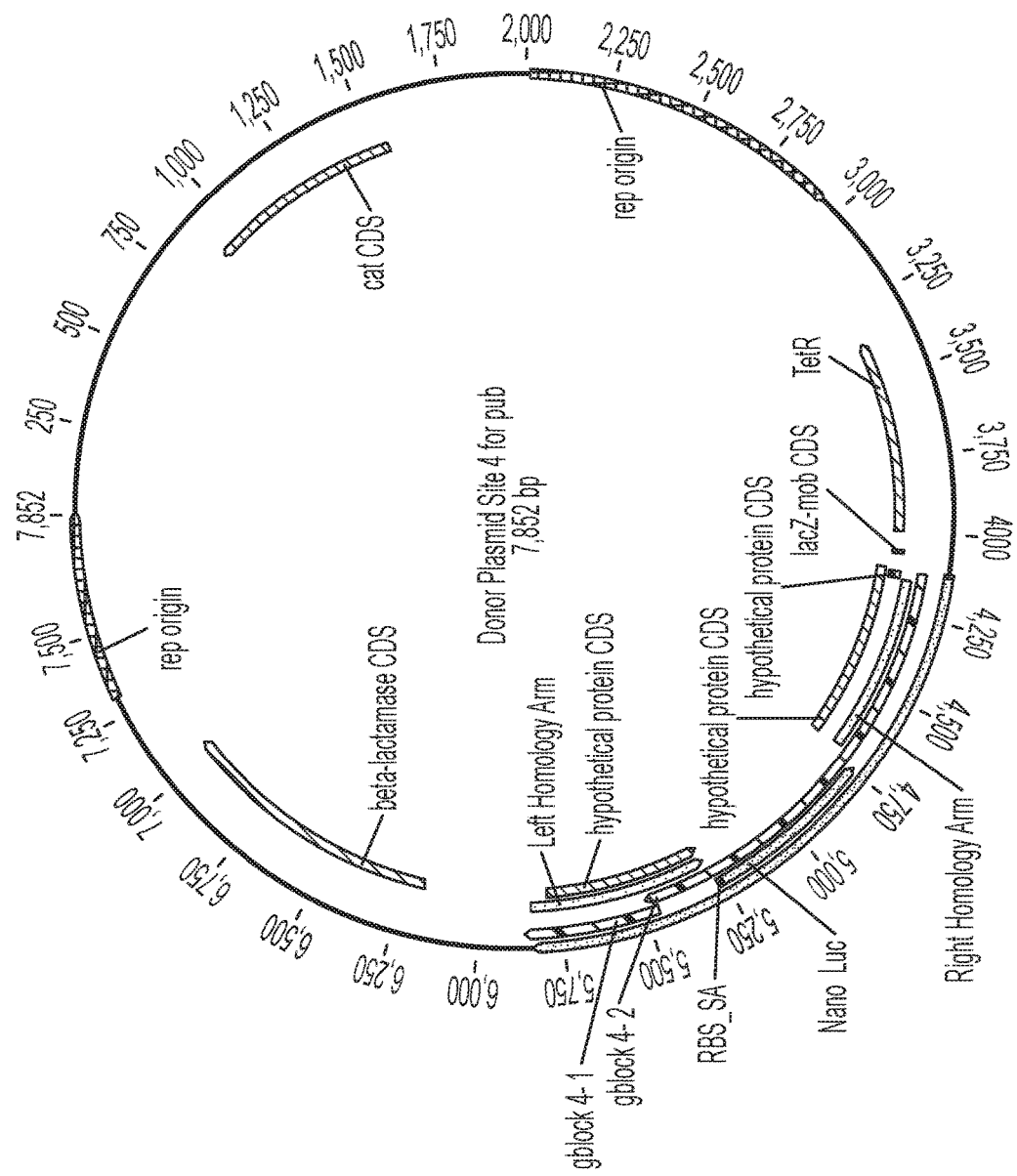
FIG. 2B shows a graphical representation of the donor plasmid.
Figure 3A:
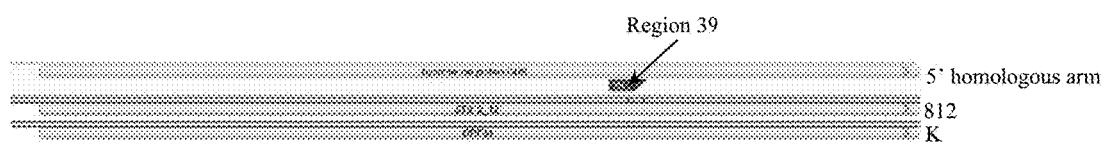
FIG. 3A shows the alignment between the 5' homologous region of the donor heterologous nucleic acid sequence and the K or 812 bacteriophage genome. Mutations were introduced in the 5' homologous region of the donor heterologous nucleic acid sequence (e.g., region 39) that confers resistance to Cas9 targeted cleavage.
Figure 3B:
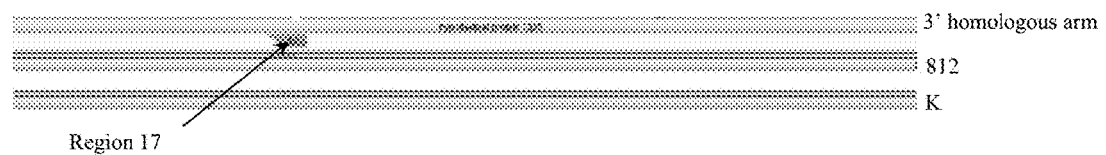
FIG. 3B shows the alignment between the 3' homologous region of the donor heterologous nucleic acid sequence and the K or 812 bacteriophage genome. Mutations were introduced in the 3' homologous region of the donor heterologous nucleic acid sequence (e.g., region 17) that confers resistance to Cas9 targeted cleavage.
Figure 4A:
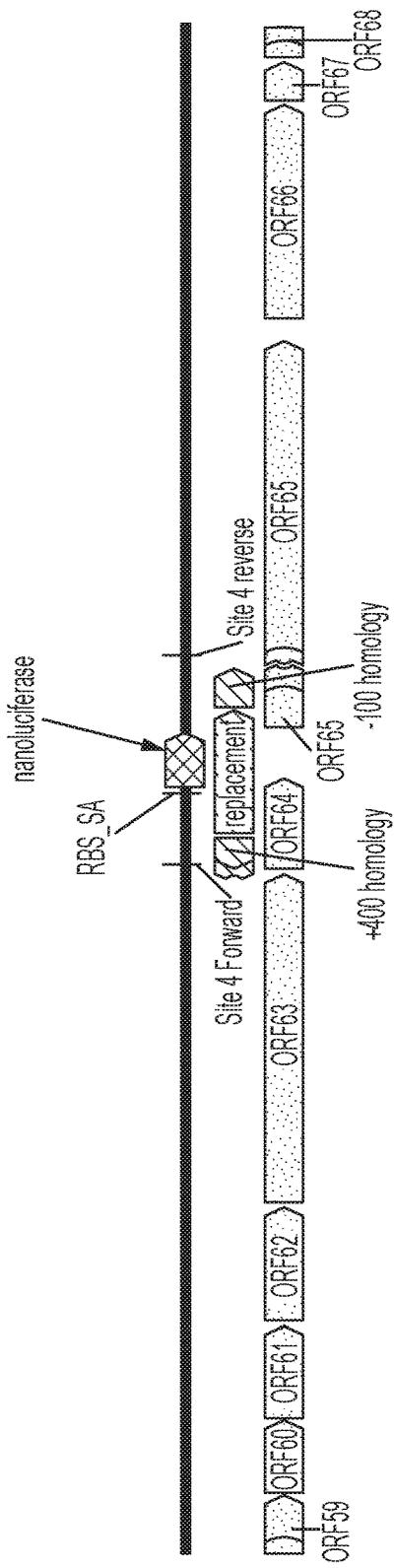
FIG. 4A shows a graphical representation of the recombined K phage genome with NanoLuc® inserted at the desired site.
Figure 4B:
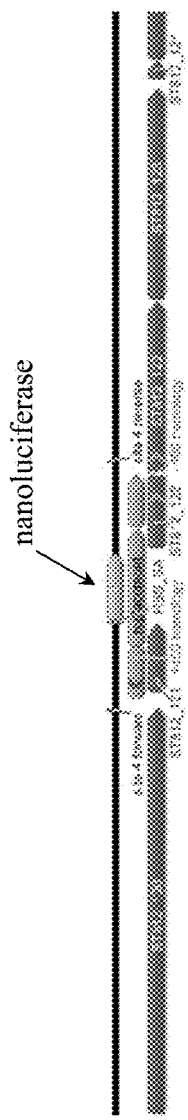
FIG. 4B shows a graphical representation of the recombined 812 phage genome with NanoLuc® inserted at the desired site.

FIG. 1A and FIG. 1B provide a graphical representation of the 812 phage genome and the K phage genome, respectively. Potential insertion sites included locations between open reading frames (ORFs) where there was no predicted terminator or promoter, indicating that the ORFs were part of a single transcript. Recombination Site 4 lies between ORF 64 and ORF 65 for phage K (see FIG. 1B) and 121 and 122 for phage 812 (see FIG. 1A). The 812 and K phage genomes share sequence identity at these locations, which permitted the use of a single donor heterologous nucleic acid sequence to generate recombinant K and 812 phages.

Construction of Donor Plasmid.

The donor heterologous nucleic acid sequence comprises a ribosome-binding site located upstream of the nanoluciferase gene (IDT, Coralville Iowa) as well as 5' and 3' flanking regions that are homologous to the K and 812 phage genomes and allow for allelic exchange at recombination site 4—namely, immediately downstream of gene 121 in phage 812 and ORF64 in phage K. See FIGS. 2A-2B, 3A-3B and 4A-4B. The nanoluciferase gene was codon optimized for S. aureus.

Gibson Assembly reaction was used to assemble DNA fragments 4.1 (SEQ ID NO: 3) and 4.2 (SEQ ID NO: 4) into the plasmid vector pRMC2. FIG. 13 shows the nucleic acid sequences of DNA fragments 4.1 and 4.2. The assembly reaction was carried out via PCR with Q5 polymerase using primers NER_pRMC2_insF (5' TTAATCGCCTTGCAGCACATCCCCC 3' (SEQ ID NO: 10)) and NER_pRMC2_insR (5' TTGGCGGGTGTCGGGGCTGGCTTAA 3' (SEQ ID NO: 11)). The PCR reaction resulted in a 1699 bp insertion into the pRMC2 vector (i.e., 577 bp 5' homologous flanking region, 535 bp nanoluciferase insertion, and 587 bp 3'homologous flanking DNA). FIG. 14 shows the complete heterologous nucleic acid sequence that was inserted into K or 812 phage genomic DNA at site 4 (SEQ ID NO: 5). Donor plasmid construction was verified by commercial Sanger sequencing.

Transformation of S. aureus with Donor Plasmid.

S. aureus RN4220 was grown for 16 hrs at 37° C., with shaking at 250 rpm, in 10 ml of TSB (tryptic soy broth). The culture was back diluted to $OD_{600}$ 0.5 in 100 ml fresh, pre-warmed TSB, and incubated under the same conditions for 30 min, and then chilled on ice for 10 min. Cells were pelleted by centrifugation at 4,000×g for 10 min at 4° C., and cell pellets were resuspended in 100 ml ice cold $dH_2O$. This centrifugation step was repeated. Cell pellets were then resuspended in successively smaller volumes of ice cold 10% glycerol: ¹⁄₁₀ volume; ¹⁄₂₅ volume; and ¹⁄₂₀₀ volume. Cells were aliquoted in 50-µl volumes and stored at −80° C. For electroporation, cells were thawed on ice for 5 min, and incubated at room temperature for 5 min. Cells were pelleted by centrifugation at 5,000×g for 1 min, and resuspended in 50 µl of 10% glycerol, 500 mM sucrose solution. 750 ng of the donor plasmid (see FIG. 2B) was added to the cells, and the cells were transferred to a 1 mm electroporation cuvette at room temperature. Cells were pulsed at 21 kV/cm, 100Ω, and 25 µF, and recovered for 1 hr at 37° C. in 1 ml of TSB with 500 mM sucrose without agitation. Cells were spread on TSA supplemented with 5 µg/ml chloramphenicol. Cells that contained the donor plasmid DNA were inoculated into TSB supplemented with 5 µg/ml chloramphenicol, and used for infections with phages K and 812.

Figure 5:
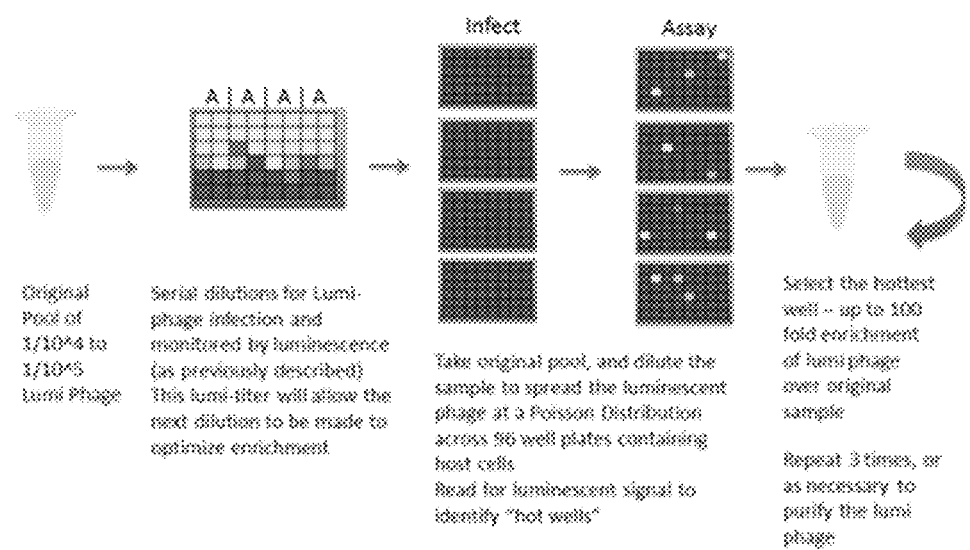
FIG. 5 shows the experimental procedure for isolating recombinant K or 812 bacteriophages.

To rapidly generate recombinant K and 812 phages, 96-well plate liquid handling robots were used to screen large pools of phage at Poisson distributions of luminescent phage, to achieve "hot spots" with locally high concentrations of luminescent phage (as much as 100× higher concentration of luminescent phage than the original sample). Iterative rounds allowed luminescent phage enrichment until purification was achieved and tested at the single plaque level. See FIG. 5. In other words, 96 well arrays were used to drive the dilution of recombinant phage in combination with rapid titer analysis of luminescent phage so that phages could be readily identified at higher dilutions compared to the traditional Loessner method (Loessner et al., *Applied and Environmental Microbiology* 62.4 (1996): 1133-1140).

Transformants containing the donor plasmid were grown under selection for the plasmid to an OD of 0.15 in TSB with 1 mM Calcium. Phage 812 and K were added at Multiplicity of Infection (MOIs) of 0.001, 0.01, 0.1, 1, and 10 to the growing bacterial cultures at OD 0.15. Phage infections were carried out for 1 hour, then the cells and cellular debris was removed by centrifugation followed by filtration through a 0.22 um filter. The phage lysate was then used to infect a counter-selection strain of S. aureus harboring a plasmid with kanamycin resistance. This infection was carried out for 6 hours, and bacteriophages were recovered from cells and cell debris by centrifugation and filtration.

Figure 6A:
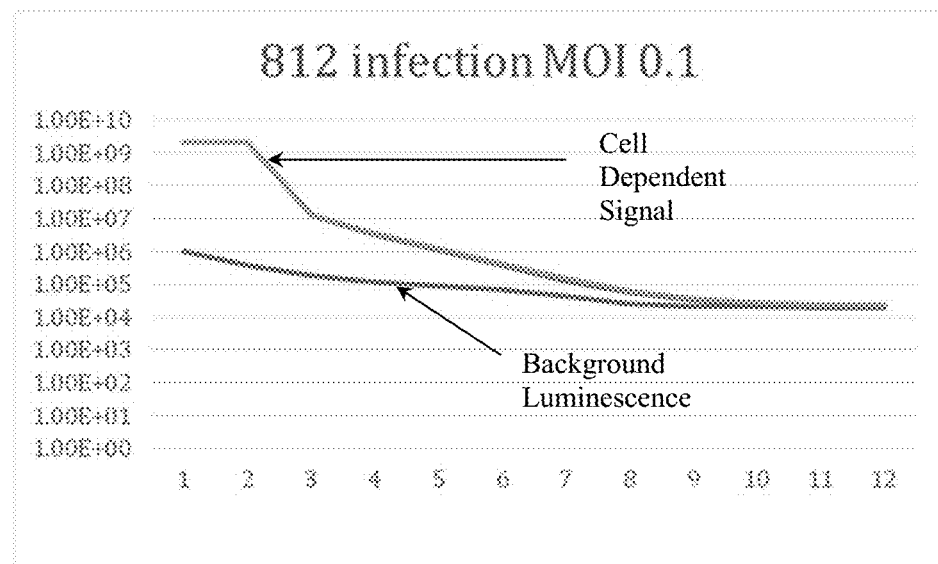
FIG. 6A shows evidence of recombination with the NanoLuc donor sequence in 812 phage at site 4 when 812 phage were infected at a Multiplicity of infection (MOI) of 0.1. The y axis represents relative luminescence units (RLU) and the x axis represents the dilution series of 10× dilutions of the sample, starting at 10 µL of sample diluted in 90 µl of cells and 10× dilutions.
Figure 6B:
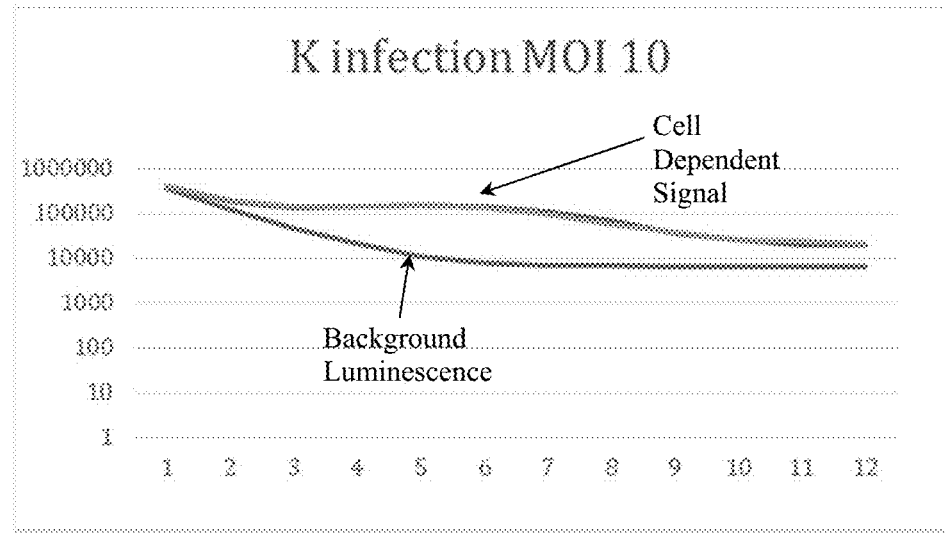
FIG. 6B shows evidence of recombination with the NanoLuc donor sequence in K phage at site 4 when K phage were infected at a MOI of 10. The y axis represents relative luminescence units (RLU) and the x axis represents the dilution series of 10× dilutions of the sample, starting at 10 μL of sample diluted in 90 μl of cells and 10× dilutions.

Lumi-titer was used to determine the success of recombination using a phage-only control. In the lumi-titer assay, host cells were grown to mid-log phase, supplemented with 1 mM $CaCl_2$ for efficient phage infection, and 100 µl of cells were then aliquoted across 96 well plates. A sample containing luminescent bacteriophage was serially diluted down the rows or columns of the plate at regular dilutions, and the plates were incubated at 37° C. for a period of time ranging from 3 hours to overnight. The luminescent bacteriophage was also serially diluted in LB to determine background luminescence. The plates were then assessed for luminescent signal, and the dilution at which luminescence ceased to be produced through the infection was used to determine the titer of the luminescent bacteriophage in the sample. Homologous recombination of the phage genome and the donor plasmid resulted in insertion of the nanoluciferase gene in between ORFs 64 and 65 in K phage, and ORFs 121 and 122 in 812 phage. This infrequent process produced recombinant phage at a low frequency of roughly $1/10^4$-$1/10^6$. FIG. 6A demonstrates that successful recombination with the NanoLuc® donor sequence in 812 phage at site 4 was achieved when 812 phage were infected at a Multiplicity of infection (MOI) of 0.1. FIG. 6B demonstrates that successful recombination with the NanoLuc® donor sequence in K phage at site 4 was achieved when K phage were infected at a Multiplicity of infection (MOI) of 10.

Enrichment of Recombinant Phage.

Spot testing for lysis demonstrated that recombinant phage were present. The expected frequency of recombinant phage during the different rounds of purification are provided below:

| Initial frequency: | 1:100,000 |
|---|---|
| Round 1 | 1:1000 |
| Round 2 | Estimated at 1:10 |
| Round 3 | Complete purification of luminescent bacteriophage |

Purified samples were plated to produce plaques. About 40 plaques were picked and tested for luminescence. All tested pickates were luminescent, and the one with the highest signal was selected for further enrichment. A second round of plaques derived from serially diluted phage were screened. All tested pickates were luminescent. The picked plaque with the highest signal was selected and used for further experiments.

The initial infection was performed on day 0, reinfection of the phage into a non-luminescent host cell grown on a counter-selection antibiotic was performed the next day, 3 rounds of enrichment were carried out over 4 days, and 2 rounds of plaquing were carried out over 2 days. Taken together, the entire enrichment process was carried out in 8 days. Flanking PCR assays were performed using primers PCDL0003 (5' CTATCTCTAAAGTAAGAAGAGTA-GAATTAAGGA 3' (SEQ ID NO: 12)) and PCDL0004 (5' ACTTTAAAACCTTTTACATAGGCTTTACCT 3' (SEQ ID NO: 13)).

Results.

Figure 7:
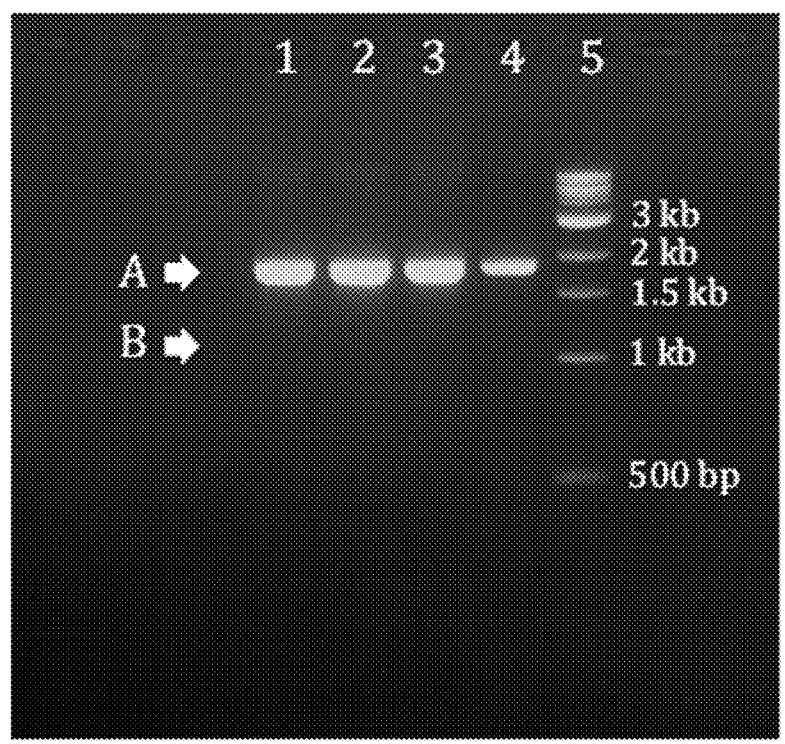
FIG. 7 shows flanking PCR assays that tested for the presence of recombinant NanoLuc® K or NanoLuc® 812 bacteriophage using primer sets that flank site 4. Lanes 1 and 3: two different Phage K infected samples subjected to flanking PCR. Lanes 2 and 4: two different Phage 812 infected samples subjected to flanking PCR. Wild-type 812 phage or wild-type K phage yield an amplicon size of 1373 bps, whereas recombinant NanoLuc® K phage and recombinant NanoLuc® 812 phage yield an amplicon size of 1908 bps.
Figures 1, 8A:
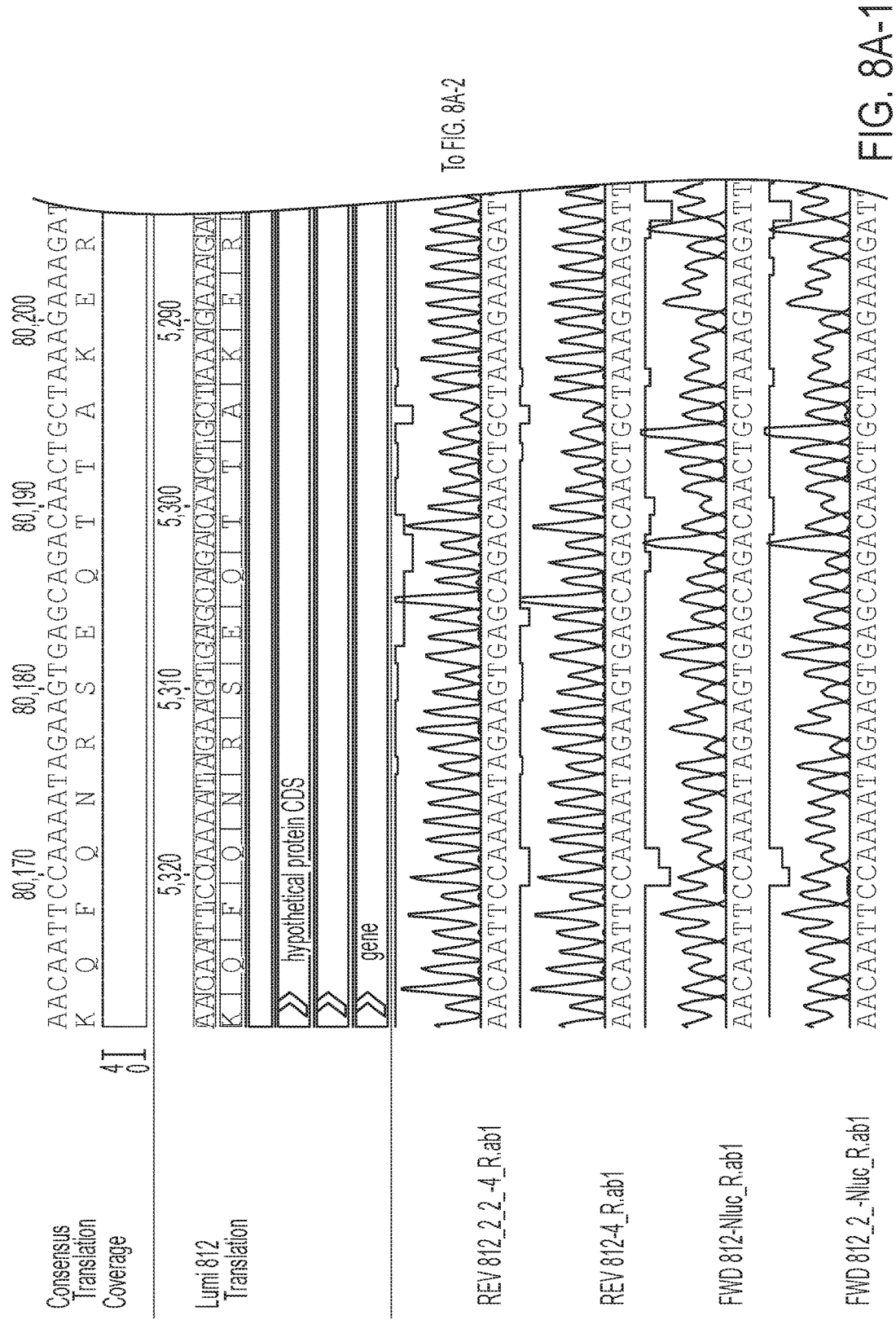
FIG. 8A shows the upstream junction sequence of the nanoluciferase insertion in the recombinant NanoLuc® 812 phage at site 4: 5' AACAATTCCAAAATAGAAGT-GAGCAGACAACTGCTAAAGAAAGATTTATTGTA-GAAGTTTA AAGGAGGATGATTATTTATGGTATTCA-CATTAGAGGATTTCGTGGGAGATTGGCGACAGACG GCAGGTTATAACTTAGACCA 3' (SEQ ID NO: 6).
Figures 2, 8A:
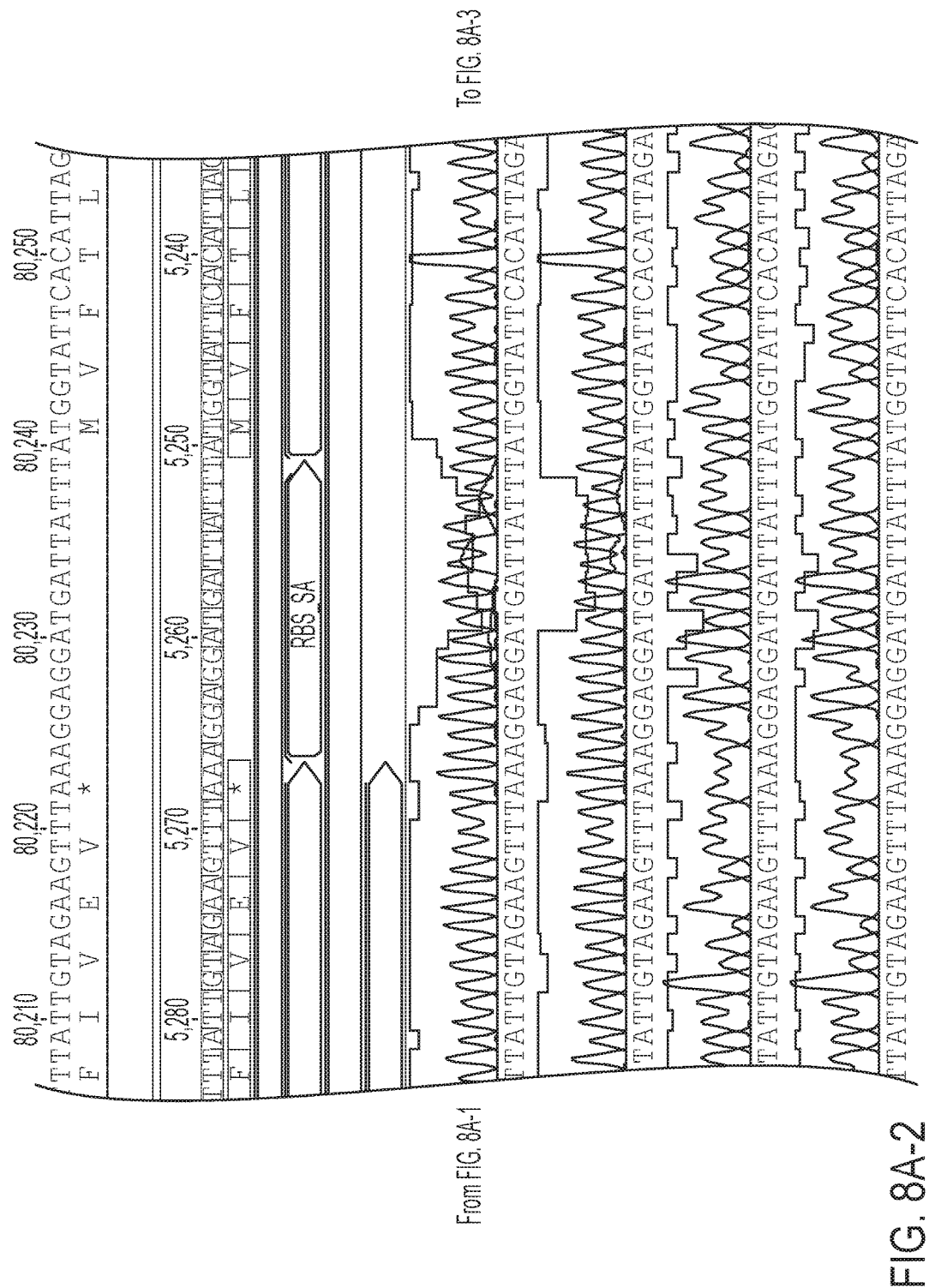
Figures 3, 8A:
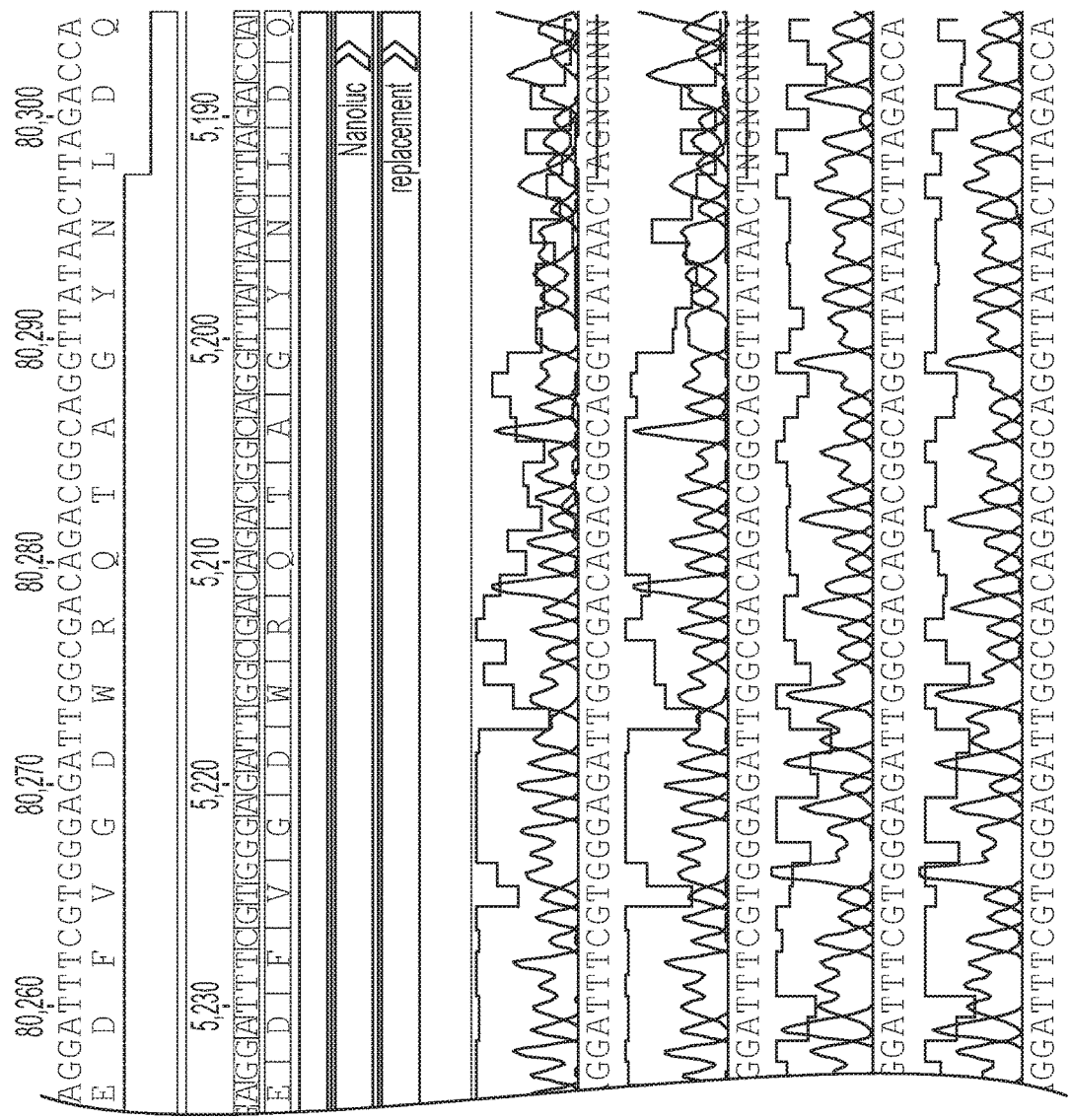
Figures 1, 8B:
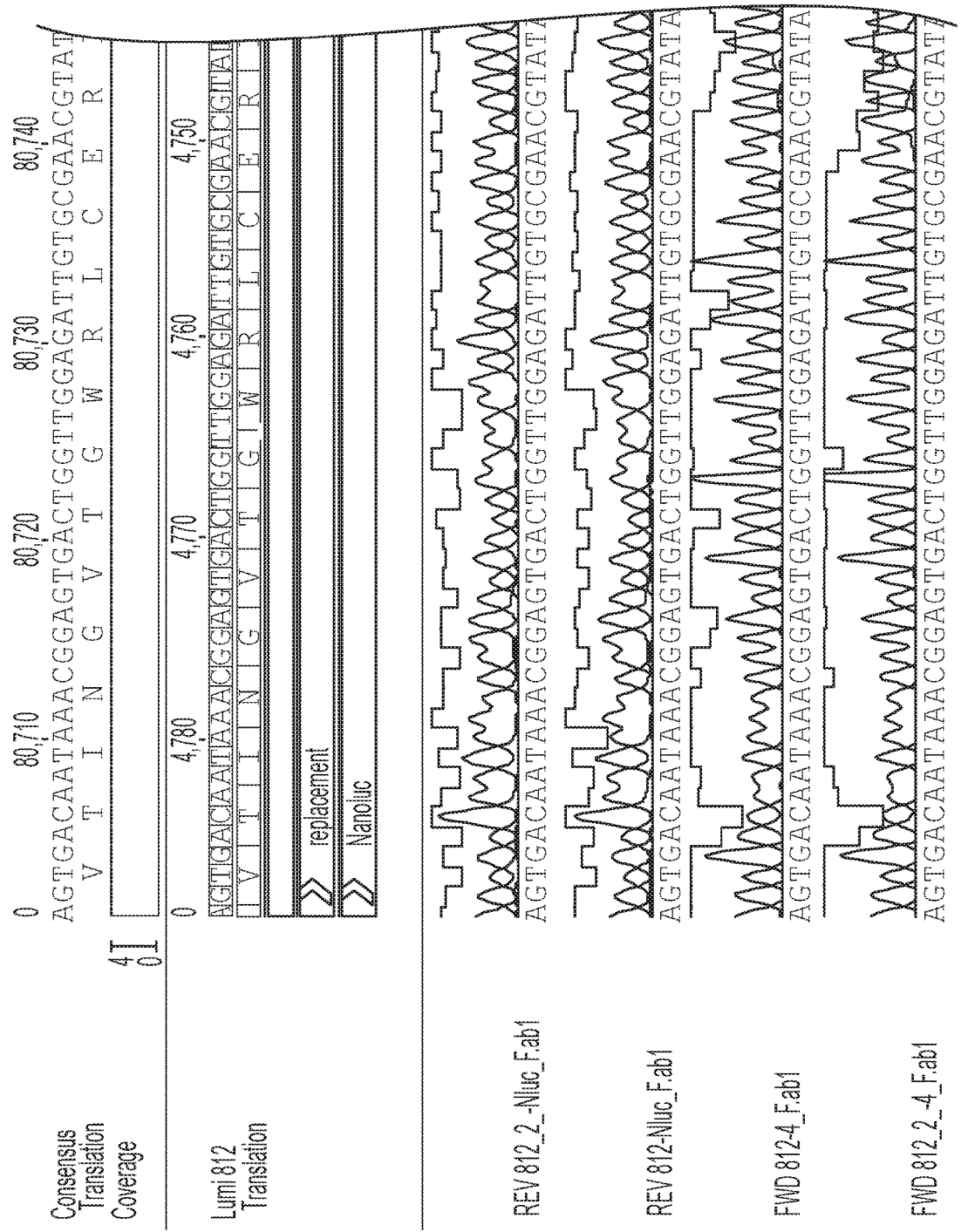
FIG. 8B shows the downstream junction sequence of the nanoluciferase insertion in the recombinant NanoLuc® 812 phage at site 4: 5' GTGACAATAAACGGAGTGACTGGT-TGGAGATTGTGCGAACGTATATTAGCT-TAATAAAGAA AGGGAGATAATTCTAAATGGCAAT-TAATTTTAAAGGTTCACCTTATTTAGATAGATTTGACCC GTCTAAAGATAGAACAAAA 3' (SEQ ID NO: 7).
Figures 2, 8B:
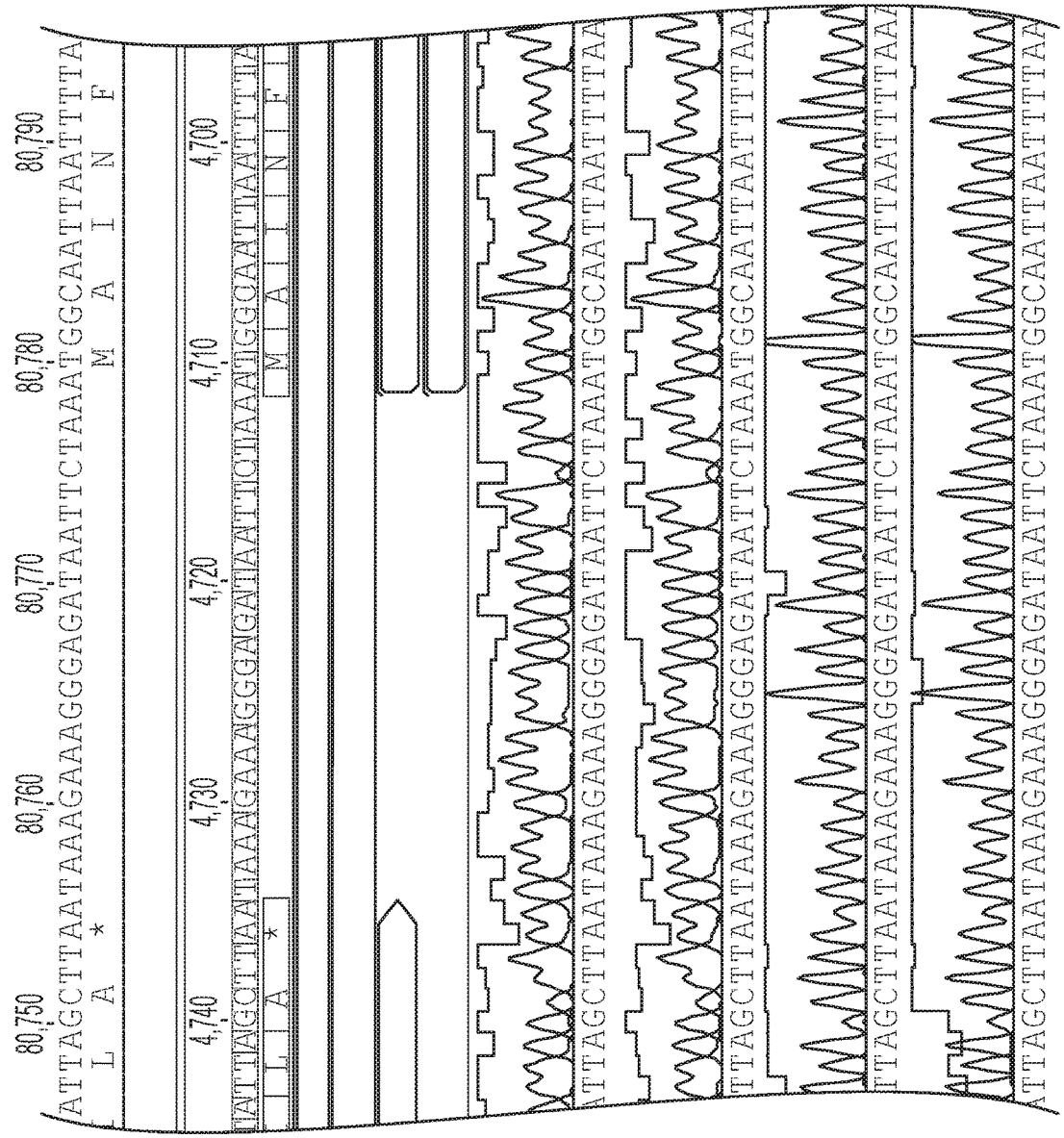
Figures 3, 8B:
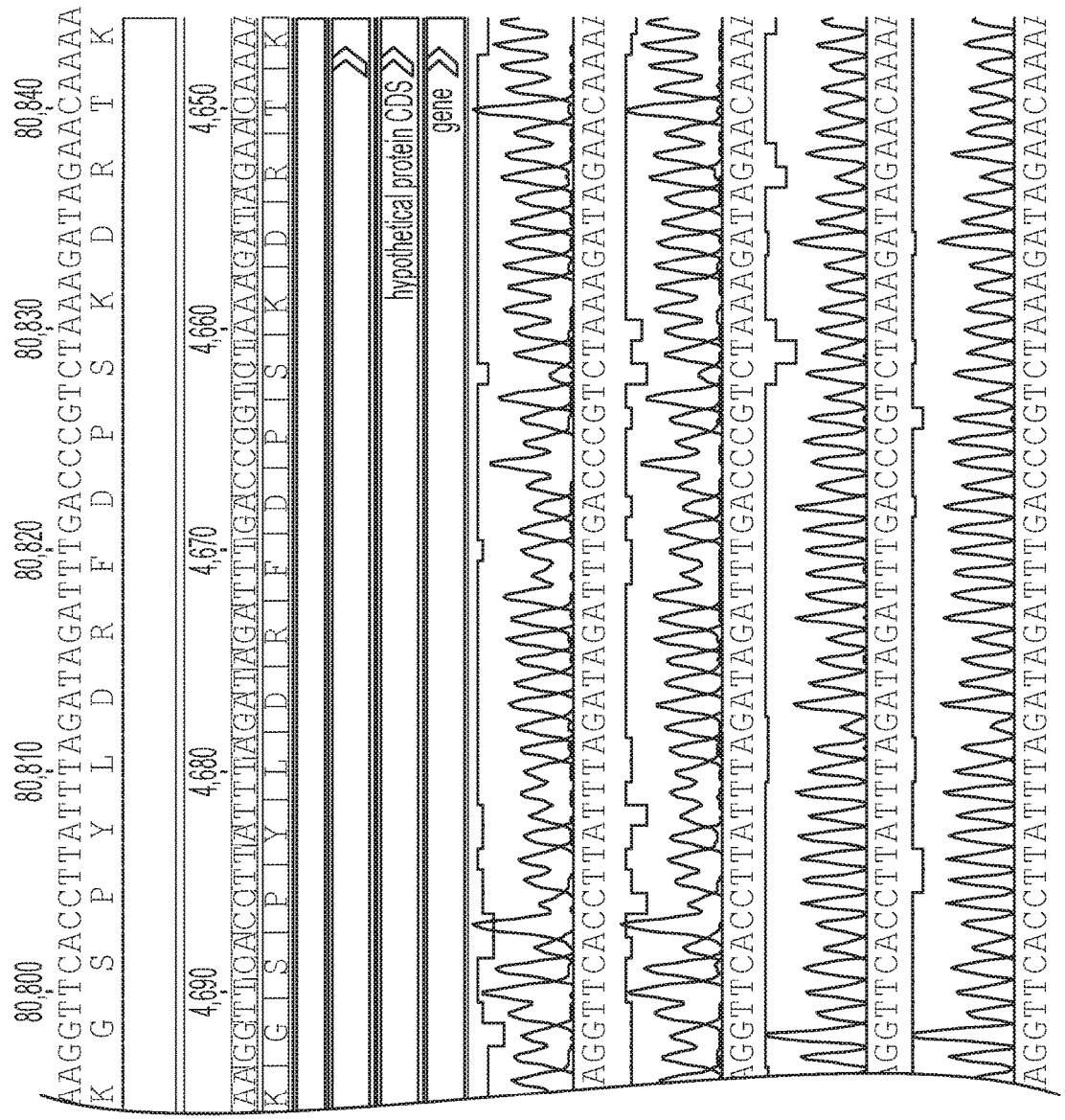
Figures 1, 9A:
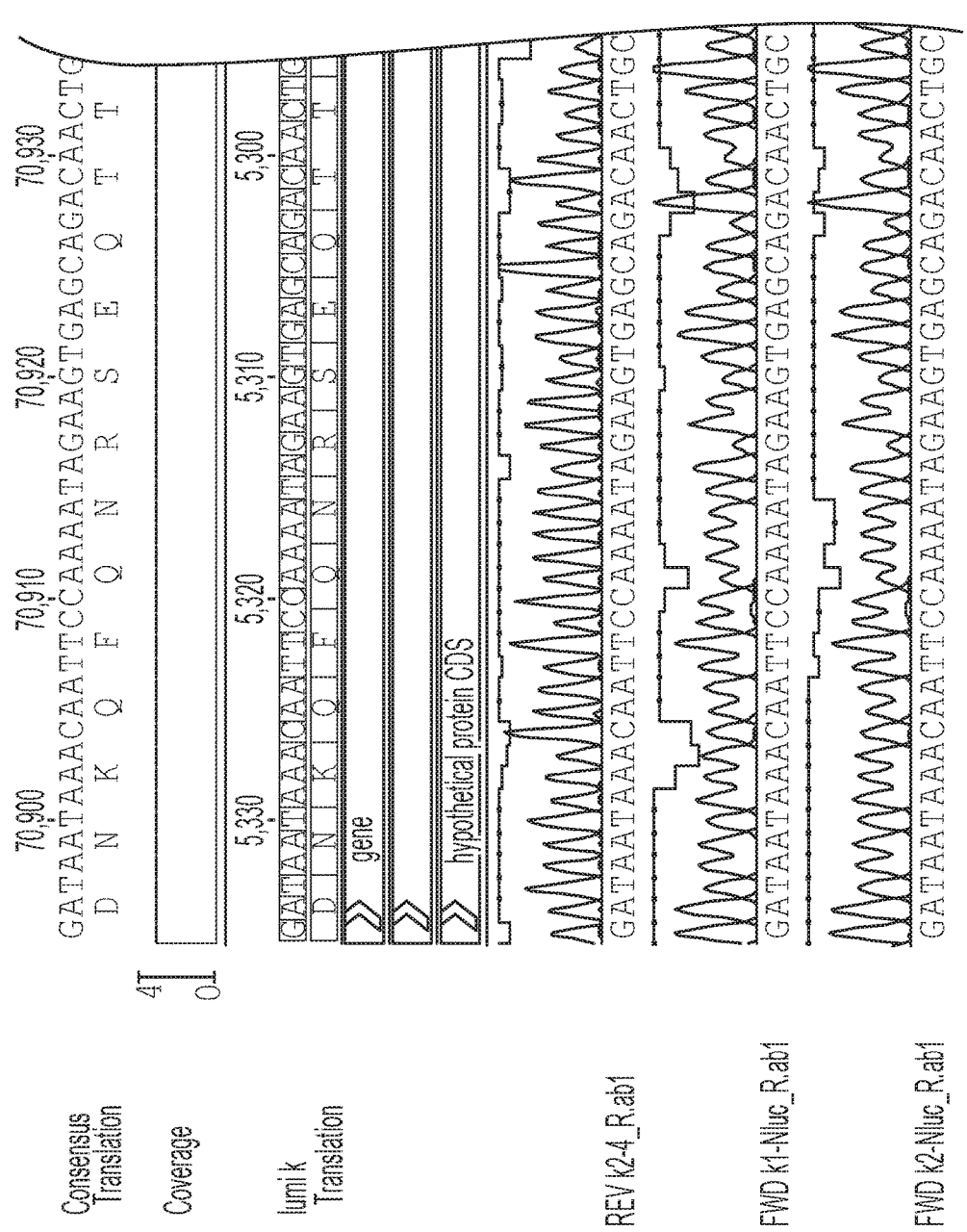
FIG. 9A shows the upstream junction sequence of the nanoluciferase insertion in the recombinant NanoLuc® K phage at site 4: 5' GATAATAAACAATTCCAAAATA-GAAGTGAGCAGACAACTGCTAAAGAAAGATTTAT-TGTAG AAGTTTAAAGGAGGATGATTATTTATGGTAT-TCACATTAGAGGATTTCGTGGGAGATTGGCG 4812-2958-7305.1 ACAGACGGCAGGTTATAACTTAG 3' (SEQ ID NO: 8).
Figures 2, 9A:
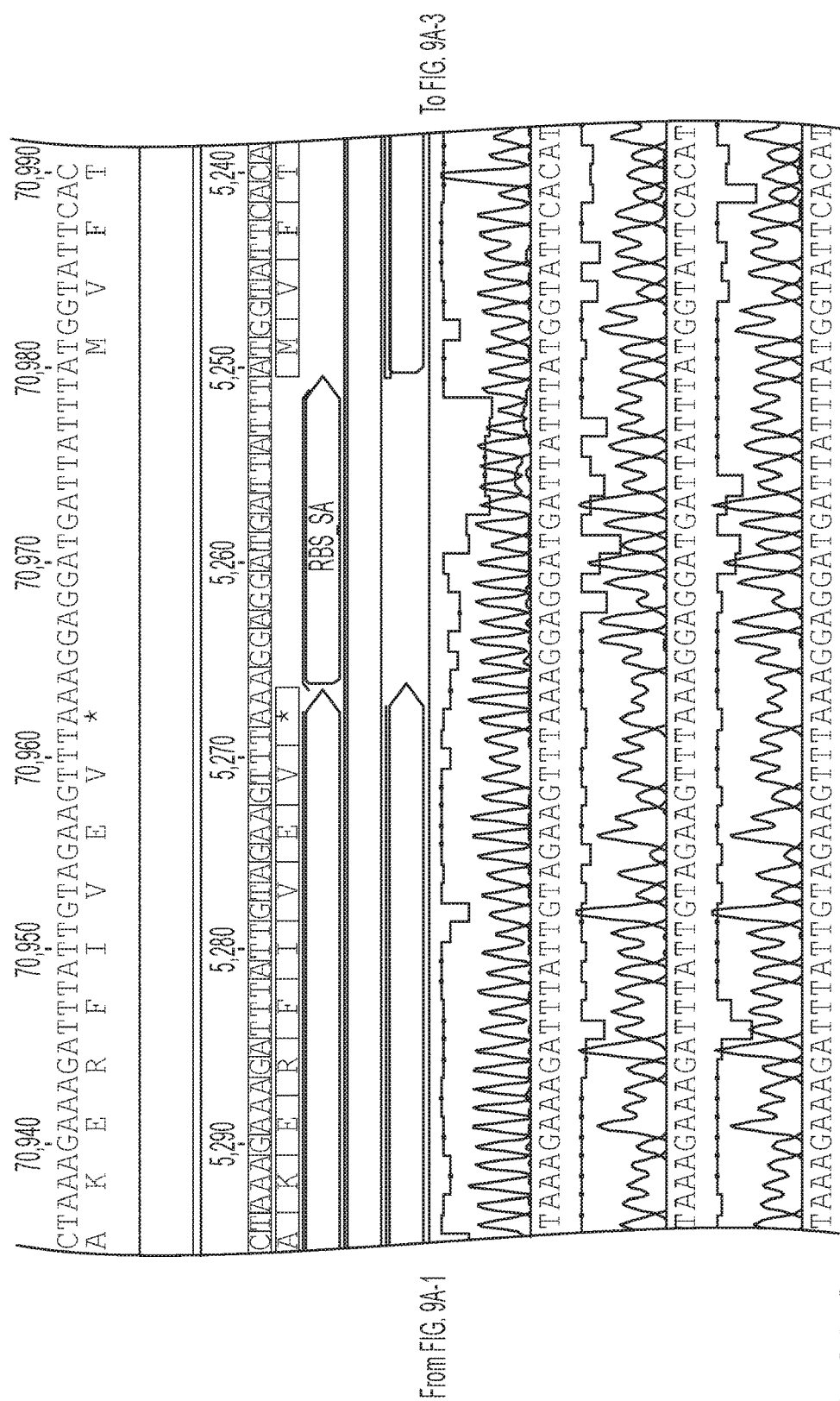
Figures 3, 9A:
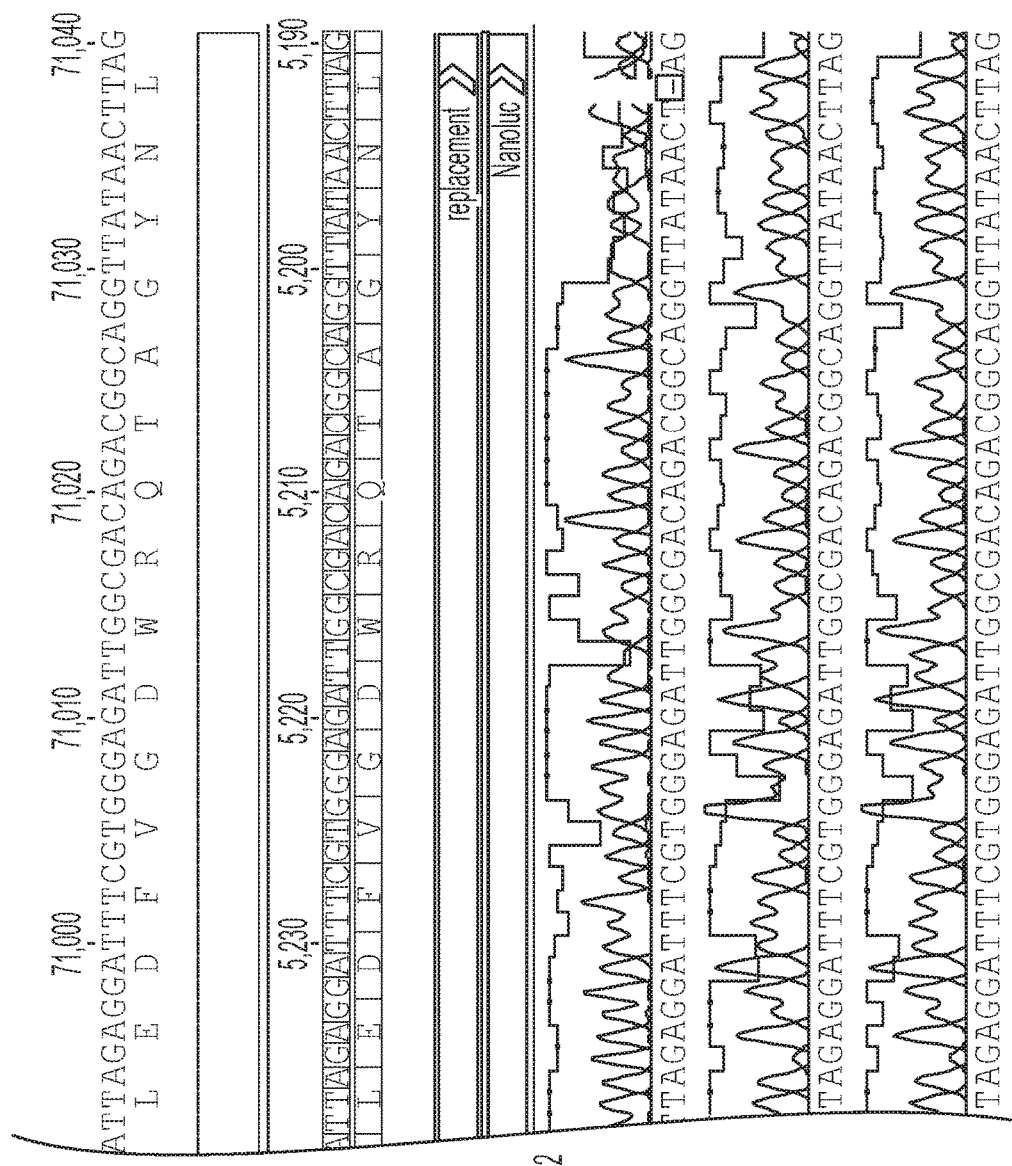
Figures 1, 9B:
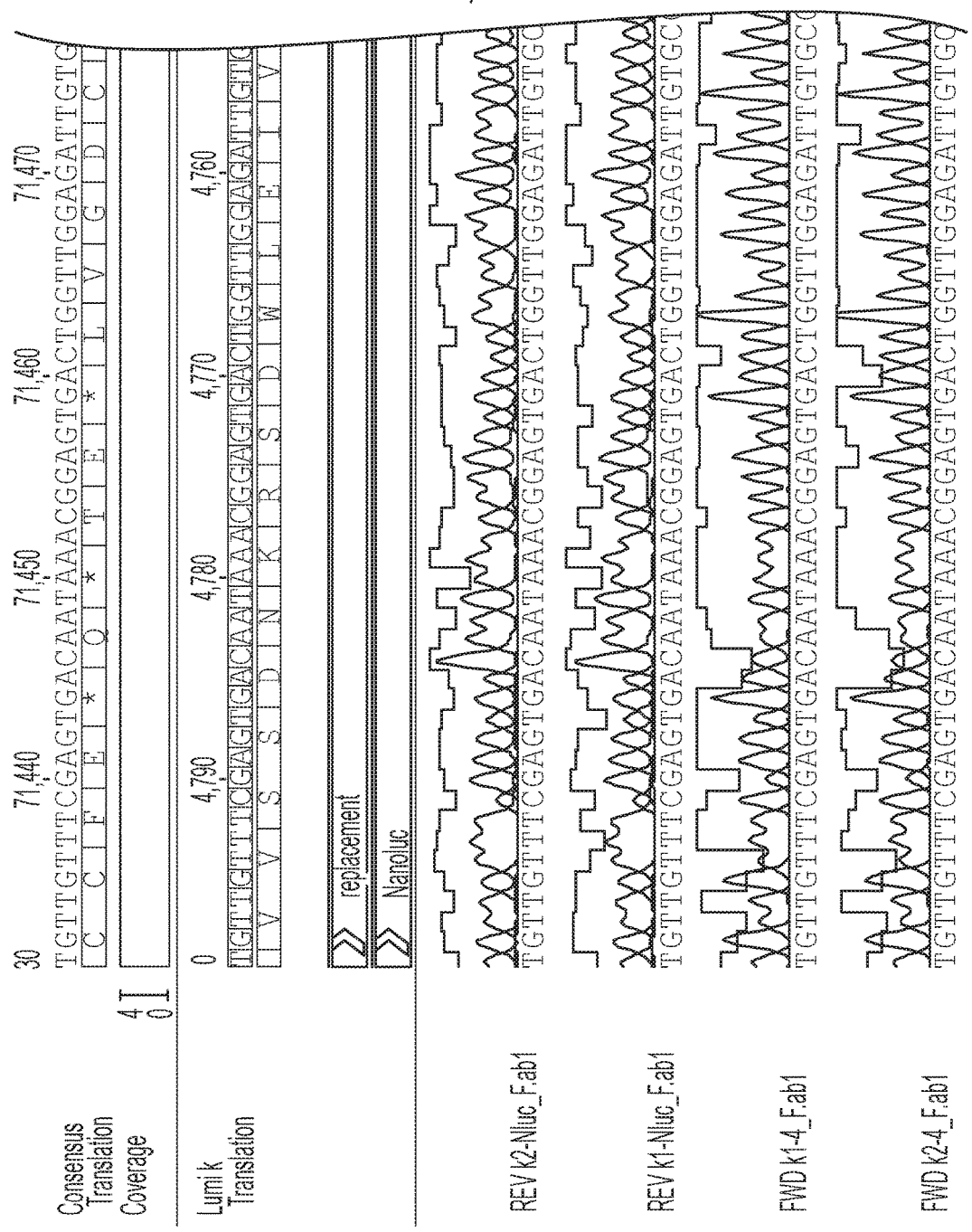
FIG. 9B shows the downstream junction sequence of the nanoluciferase insertion in the recombinant NanoLuc® K phage at site 4: 5' TGTTGTTTCGAGTGACAATAAACG-GAGTGACTGGTTGGAGATTGTGCGAACGTATATT-AGCT TAATAAAGAAAGGGAGATAATTCTAAATG-GCAATTAATTTTAAAGGTTCACCTTATTTAGAT AGATTTGACCCGTCTAAAGATA 3' (SEQ ID NO: 9).
Figures 2, 9B:
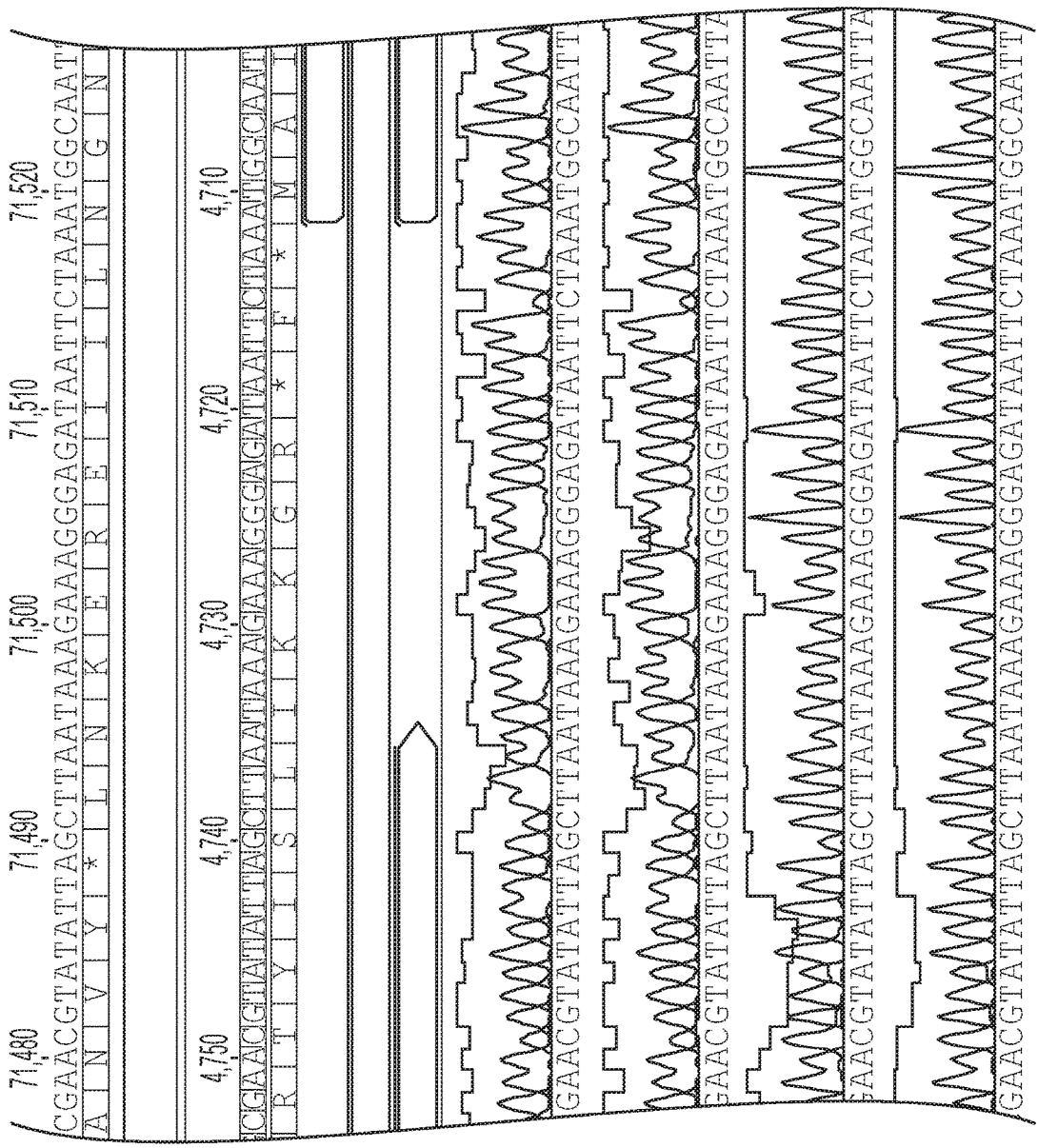
Figures 3, 9B:
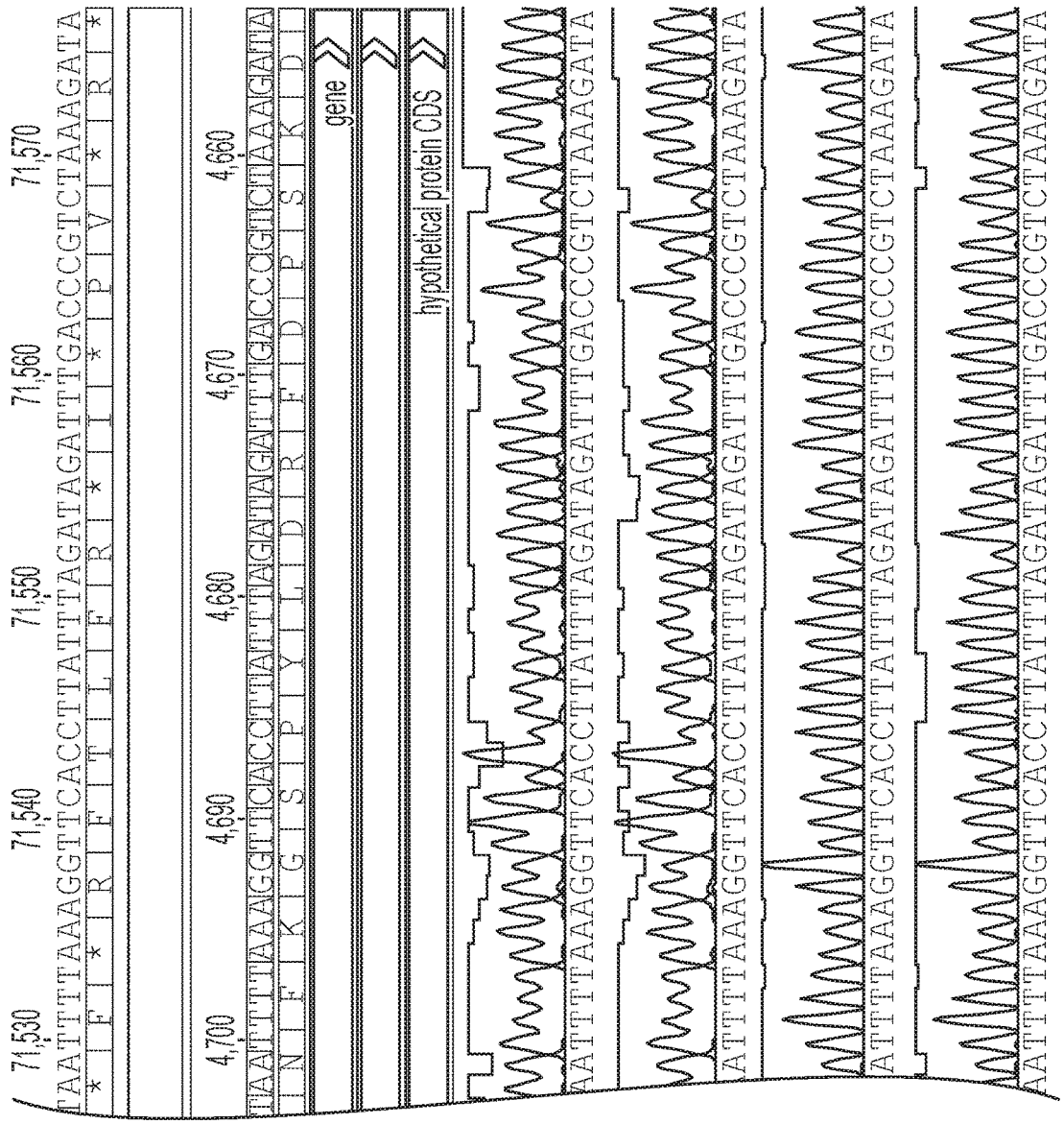

As shown in FIG. 7, recombinant NanoLuc® K phage and recombinant NanoLuc® 812 phage yielded a 1908 bp amplicon, whereas wild-type K or 812 phage yielded a 1373 bp amplicon. PCR products were subjected to Sanger sequencing in both forward and reverse directions to confirm the sequence of the nanoluciferase insertion. FIGS. 8A-8B show the upstream and downstream junction sequences of the nanoluciferase insertion at site 4 within the recombinant 812 phage. FIGS. 9A-9B show the upstream and downstream junction sequences of the nanoluciferase insertion at site 4 within the recombinant K phage. FIG. 18 shows the complete genome sequence of the recombinant NanoLuc® K phage of the present technology. FIG. 16 shows the complete genome sequence of the recombinant NanoLuc® 812 phage of the present technology.

These results demonstrate that the methods of the present technology are useful for making the recombinant K or 812 bacteriophages disclosed herein in a bacterial host cell. Accordingly, the methods disclosed herein are useful for generating recombinant K or 812 bacteriophages that can be used in the identification and/or antibiotic susceptibility profiling of specific *Staphylococcus* strains/species present in a sample.

Example 2: Functional Activity of the Recombinant K or 812 Bacteriophages of the Present Technology This Example demonstrates that the recombinant K or 812 bacteriophages of the present technology are useful for the identification and/or antibiotic susceptibility profiling of specific *Staphylococcus* strains/species present in a sample.

The lower limit of detection (LLOD) of the recombinant K or 812 bacteriophages disclosed herein was determined as a measure of cellular sensitivity. The recombinant phage were purified from bacteriophage lysates by size filtering with a 300 KDa cutoff (Sartorius, Göttingen, Germany) for retention and washing recombinant phage followed by binding to a monolithic DEAE column (BIA Separations, Ajdovščina|Slovenia) for elution of highly purified recombinant phage. Phage purification removed impurities such as the luciferase enzyme that is generated during the production of lysate. The highly purified recombinant phage exhibited low background luminescence that is described by the LLOD (the luminescence signal of the recombinant phage only control is measured 3 times and the standard deviation is multiplied by 3 and then added back to the luminescence value of the recombinant phage only control). The intersection between the light signal for samples containing target bacteria and the LLOD defines the sensitivity for a given preparation of recombinant phage.

The sensitivity of recombinant 812 and K phage were evaluated with *Staphylococcus aureus* strain NCTC 9318 (ATCC, Manassas Va.) grown to an OD of 0.17, and diluted at 10× increments down 12 orders of magnitude. 1E7 PFU of FPLC purified recombinant 812 and K phage was added to each well, and infections were carried out for 1 hour. Additionally, the cells at these same dilutions were plated on TSA overnight to determine the Colony Forming Units (CFU) of the data points. Luminescence was measured and all dilutions were carried out and measured in triplicate. The background luminescence was calculated as the luminescence of recombinant phage only control grown in LB (uninfected control).

Figure 10A:
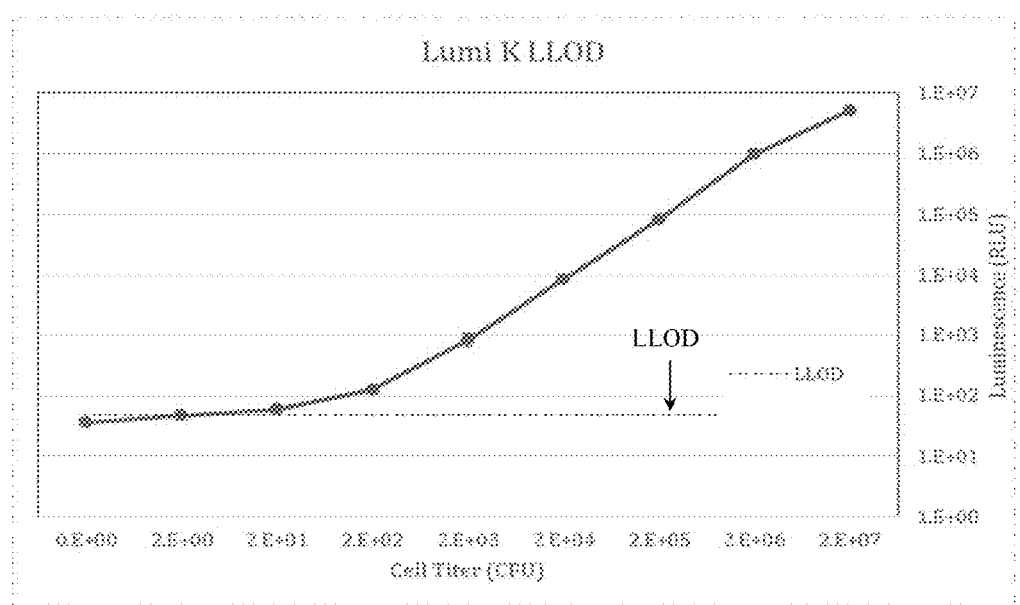
FIG. 10A shows the lower limit of detection of the recombinant NanoLuc® K phage of the present technology. The relative light unit (RLU) values are represented on the y-axis and cell number on the x-axis. The left-most data point is the background control with 0 cells. The dotted black line represents the background RLU plus 3× the standard deviation, giving the LLOD cutoff of the recombinant NanoLuc® K phage.
Figure 10B:
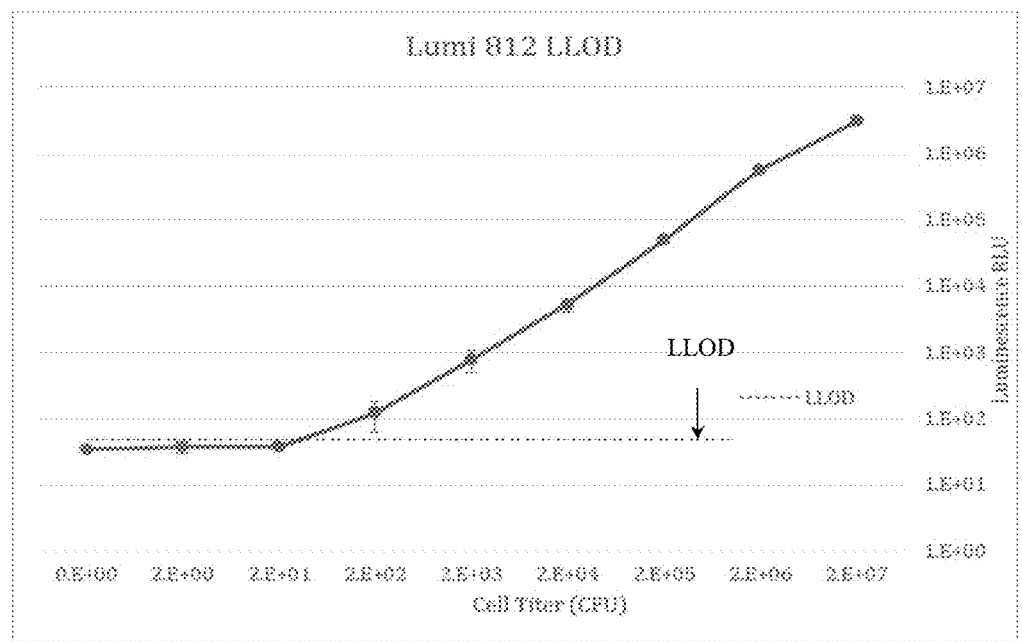
FIG. 10B shows the lower limit of detection of the recombinant NanoLuc 812 phage of the present technology. The relative light unit (RLU) values are represented on the y-axis and cell number on the x-axis. The left-most data point is the background control with 0 cells. The dotted black line represents the background RLU plus 3× the standard deviation, giving the LLOD cutoff of the recombinant NanoLuc® 812 phage.
Figure 11:
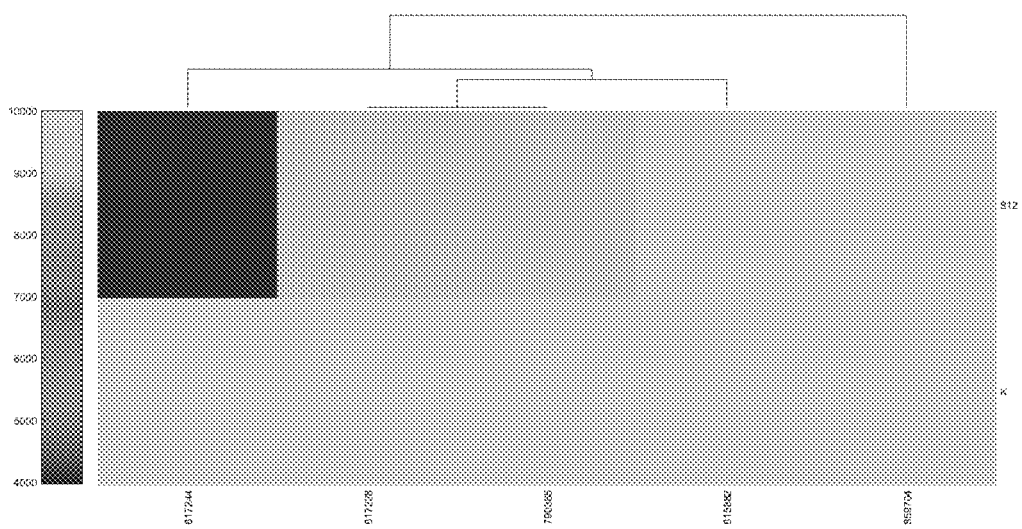
FIG. 11 shows a comparison of the host ranges of recombinant NanoLuc® K phage and recombinant NanoLuc® 812 phage. 5 Strains of blood derived *S. aureus* are represented on the X axis, and recombinant NanoLuc® K phage and recombinant NanoLuc® 812 phage are represented on the Y-axis.

FIG. 10A shows the lower limit of detection of the recombinant NanoLuc® K phage. FIG. 10B shows the lower limit of detection of the recombinant NanoLuc® 812 phage. FIG. 11 shows a comparison of the host ranges of recombinant NanoLuc® K phage and recombinant NanoLuc® 812 phage. As shown in FIG. 11, the range of *S. aureus* strains infected by recombinant NanoLuc® K phage is distinct from that observed in recombinant NanoLuc® 812 phage.

Figure 12A:
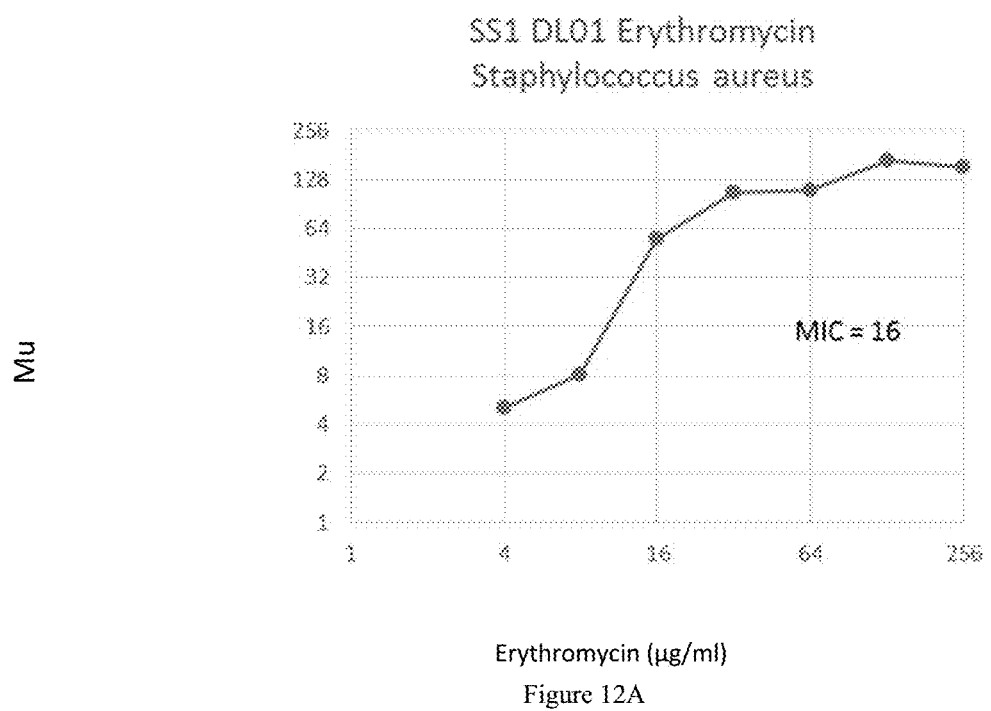
FIG. 12A shows the antibiotic susceptibility profile of a *Staphylococcus aureus* strain SS1 DL01 to erythromycin using the recombinant K and 812 phages of the present technology.
Figure 12B:
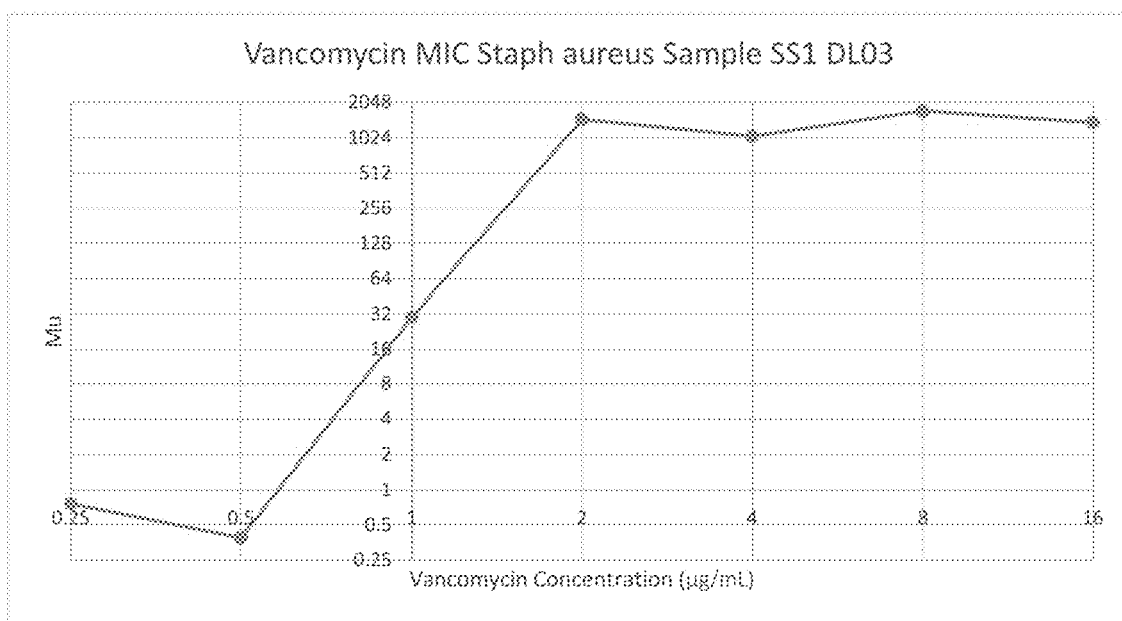
FIG. 12B shows the antibiotic susceptibility profile of a *Staphylococcus aureus* strain SS1 DL03 to vancomycin using the recombinant K and 812 phages of the present technology.

The use of recombinant NanoLuc® K phage and recombinant NanoLuc® 812 phage in profiling the antibiotic susceptibility of select *Staphylococcus* strains at different concentrations of erythromycin and vancomycin was tested. After infection with the phage, 50 μl of the reaction was added to 50 μl Nano Glo Luciferase Substrate (Promega, Madison, Wis.) in a luminescent plate and read in a luminometer. The minimal inhibitory concentration (MIC) of each sample was determined using the ETEST® method (Biomerieux, St. Louis, Mo.) according to the manufacturer's instructions. The differences in the reporter gene expression of the recombinant K or 812 bacteriophage observed in the antibiotic treated samples and the untreated control samples is defined as FIGS. 12A-12B demonstrate that the recombinant K and 812 bacteriophages of the present technology were effective in determining the antibiotic susceptibility profile of various *Staphylococcus* strains.

These results demonstrate that the recombinant K or 812 bacteriophages of the present technology are useful for detecting and/or profiling the antibiotic susceptibility of target bacterial strains/species present in a sample. Accordingly, the recombinant K or 812 bacteriophages disclosed herein are useful for the identification and/or antibiotic susceptibility profiling of specific bacterial strains/species (e.g., *Staphylococcus* strains/species) present in a sample.

EQUIVALENTS

The present technology is not to be limited in terms of the particular embodiments described in this application, which are intended as single illustrations of individual aspects of the present technology. Many modifications and variations of this present technology can be made without departing from its spirit and scope, as will be apparent to those skilled in the art. Functionally equivalent methods and apparatuses within the scope of the present technology, in addition to those enumerated herein, will be apparent to those skilled in the art from the foregoing descriptions. Such modifications and variations are intended to fall within the scope of the present technology. It is to be understood that this present technology is not limited to particular methods, reagents, compounds compositions or biological systems, which can, of course, vary. It is also to be understood that the terminology used herein is for the purpose of describing particular embodiments only, and is not intended to be limiting.

In addition, where features or aspects of the disclosure are described in terms of Markush groups, those skilled in the art will recognize that the disclosure is also thereby described in terms of any individual member or subgroup of members of the Markush group.

As will be understood by one skilled in the art, for any and all purposes, particularly in terms of providing a written description, all ranges disclosed herein also encompass any and all possible subranges and combinations of subranges thereof. Any listed range can be easily recognized as sufficiently describing and enabling the same range being broken down into at least equal halves, thirds, quarters, fifths, tenths, etc. As a non-limiting example, each range discussed herein can be readily broken down into a lower third, middle third and upper third, etc. As will also be understood by one skilled in the art all language such as "up to," "at least," "greater than," "less than," and the like, include the number recited and refer to ranges which can be subsequently broken down into subranges as discussed above. Finally, as will be understood by one skilled in the art, a range includes each individual member. Thus, for example, a group having 1-3 cells refers to groups having 1, 2, or 3 cells. Similarly, a group having 1-5 cells refers to groups having 1, 2, 3, 4, or 5 cells, and so forth.

All patents, patent applications, provisional applications, and publications referred to or cited herein are incorporated by reference in their entirety, including all figures and tables, to the extent they are not inconsistent with the explicit teachings of this specification.

SEQUENCE LISTING (29 sequences)

SEQ ID NO: 1 - DNA, 127395 bp, Staphylococcus phage K
ggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcttaaccgcttctctaatacaattaatcaggagatgttgaagatgaatacaagacgggtaaacagagcgttaaacgaagcagttagattattagatgaacaaatagcagatactcaaaagactatgcaggagttgaataaacaactagagaagcaaataaaggctaagcaagagctaatggtattagttgatgttatgaatggtgatgatgagtaatgaacattagagaggttcacaatgtcgttaagagtgctaagagcaaactcctgcaggagcaggctcacccaacggataacctcatagagcagtacatcaatgatgagctacacagacgcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatgatataatgaacttaacaaattaaaagaaaaggaaatgatgaacatgacaaacttacaagaaagaaaacaagaattgaaaacgttactatttaacttagctttagagaagaacaaagcaactgatgagacactgcttagcgtattagagcaagcacatcaagaggtaggaaatcaattaagaaaagtaagaaaagaaatagaaattttagtagaagaaaaagaaagggaattttggaatgatatcgaatttaatggattagactaagagggaataaaatccctcttttatttttatcctattatataatttttttatattatacgggggcaggggtaaaatgccactcaatgggggtgggtctatatacccctatggtctacccaggtacttattttttggggaaaattatgaaaataaatatttaaaagtcaacacctaaaatatagaacgtaagtcaacaccctatattaaaagtcaacaatttatagtacaaatagagaacctctaaatataaagtcaacatatctaaaataagaaagagggaaattaaatccctcctcttaggtattattaacaacctctaattcatgtatagtaatcatatccatcccatagaaatctcttgggtctcctttaatgaactcttgctctcctctatggtttgtttcctctttataaccttcttctttaatacgtttaattaagttctccttatctgtatatatcttatcttctctaaaatggaagttatcttcataaggttcacaattatcatgttctacttggtatagtttcattagtcattttcctcctcttcgtaagaccatgtaccatattctgcattatagtgtgctgtatctgcgccttcatcttcatattctacactataccatgcatcctcctctgtttctgcatctatatatcttacctcttctgtagtaatagtacgttttactttgtatctcttcaactgtttttactcctttatattttcctctagtatttgttttaatgtctgacagtctttttggtctagagtatcccaactctctaaattttgtaattggtatagtaactcatttacaatttcatcgaaggcttctgcttttttatatacttcttctagttctgtttctgctaattttctattccttttaatttgttctgctttagctactaagatatgggctttattcatttcctctataataaagtttttatagttttccattattatttatccctcctattttctatccgttgttttatctcttctctattgcggtggtgctccttactcatttctttacgttccttatttgttaaccttatcctataaacaaggtagttaatgtataagataccggctgaccatagtagcaagaatgatattaaataagtccatgagatactaatttctatcattgtgagtcctccttatattctttatagctcttaatggctattttacaaatacctctatttacagcaacaaatactataaatgataatagtgttataactgctcttacatcccctgtaaaaggtaatgattgaaagagcaaatagttttctaaaacactaatagctgtaatagtagttagatataatatagataataagtaatcctttaattttagtttaacaaatggttttttgtgctcacctgttcttacaataccataaagtattatgaaccacataacaggtactaactgtataataaaatcattgtctacatttaatgcatgtagagcgtaaataataactgcaggaatacctataatgaatgctagaaatacataaaatataattaacattataggaagggctacaagaaaacctagaccttgttttgaatactctaatgtgtttttacctaggaacttaaaaaatgttttattcatcttcttcctccttggaattactttctgtaattgtaatttctaacatattattgtaataatcattcttttgattgatattatagttatcattgtattcattaaagtctacataaatatattcatttgcgtcattttcataaataatatctatagctgtaatatctgaatatgctgtaatcatttcataagcgttcgtattatcaggataagcaaaaccaacttgaggtatttccataggcttatcaataagaataccgaaataagtacagtgacgtgttcgacttatacttgaagtccctttatatgtaccatagtaatctataccttctgtaatacctgatatatggaacctgcttacgtctttaggctctaatcttacaacatcgcaattctctaatactaaatcaatatatttgatattcattttaactctccttttatattaataattttttccattctttatcaacctttttaagttcttttttattatagtccccgtctttagttactacagtgttccattggaacttttgtaataagctaaaattatttataatccatatattacttttactataatacatattgtcttcaaatcttatatctttttctataaaatatttatatattttatatcttctttcatctgcacctgatattttaataatttcattagtatttaattgagtggataactggaagataacatcttttactttcaataggtctttaacattacctctgcctacatggtcattatagcaatcatatttaacttttttcttttgttttctatcattaactacaatgaatatattatatacgatataagctttaaaatgggtataggtagtaggtgcttctgaatcatcacattcttttcttaggtctgtacattgtatttttaatgtaatattatttgatatgttaactacagtagagccctcatgttttttattaagatttatcttatccattttataattacctacttattgtagatacaatgtactcgaacatcttccattactttgcctaatagattctgacctttccagttactttgctctaatattttagggtcatttgctttaagacctactccccatattttatcataaggtgaagcttctacaaaatctttacgtacatctgtgtctaatattctttgctttaggtgtgtagtcataaatttatctttaactacttctaccataatattatatcttactttattccactgttcttcattaaaattacgaactttacgacctaaacttttagcatggtttgggttcttagcatttagtatttcacctgctatttgaaagtcattaaagtatcttgctttgcgccacataaaggcttgctctgagttattaaatgttcttccttggtgtttaaactttatagggtagaaattagaataaatatcctctttaccccaaaacataatatattcccttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatgattactactctctataaatgcatttaggtcagcgtatagctgaataaaaaaggacatgtcataattccaatacttaggttcatttctacctagttttttcttcattttcttatattttttattcttttttatcccaaaaacttctttttcaaagtcattcaatttaagacctttaaaatattttttcttcatttcttaacctccaatttaataaatggaaaatcaatgtttctaaatactgcgccaacatcacacattaacatgtctccattaatttctacttctccactgtctgtaggggtgtgaccacatacataggtaaaaccatcttttctaggttgaaagtctcttgaccatattaattggtcaattgtttgttcttctacaggtttccaactaaccccacctgaatgagagaatatatacttgtcttctttatagtactttctacaattaaccataagtattttaaattttctatagtcgtctgattctttaagtttctttagttcacttttaataaaatcataattatttcttagattttcctctacactactatattttaaagttactgtactcacaccgtaagagttaagtgtttctatacaatatcttgagagccattcaatatcatagatacttaatcggtctacgttttccataatattataaaactcatcatcatggttccctaacagagttactacattatcatcattagacattaaatcaaatatatagttaacaacatcttttgaccttttacctctatctacataatctcctaaaaatactattgtttcttcaggttttctttcattatttattttatccataattgttaataatttttggtattctccgtgaatatcgggaacaacgtatatagccatctaatctcctccttattgtatataactatcttaccatacttagtaaaaaaagtcaataaaaaaacacctattaaattaataggtgtttatcatttaatgttattttaaagtatcattaccatgtgctaattttttatcatctattgcatggtcattataaatatatttaacctctatatactggtcttcacttttcagtgcatctactatagaagcattattagttattgagcttgttctagggtaagtaaatttttgaccgtcagataaaataatagtaacatcaacttcaaagttaacaggtagtctgtatccataatcttccaaataattaataaagttattaagagaaaatggtttatacttgccatctaaggtatagtcaatatattcatttaatgcattagtaagttctgattctgttaactccattgtatcataatctttttcgttatagaatactacaacattaggttgttctatactagaatctccgtctttatacttagatataaaaaatccaatatttcctttatgctctaaataatctgctttcataattttaagtacttcttctgctataggttttgctaatagtgttacccattcacctttttctgcgtcataaacactaggtagtacgtttaccatcatttaaatctcctcttcttaatttattggtttaaaccacaatttactcttatcacttggttctgtttcactaactacgaaagagttagaatcaatgtttaaagtattaaaaacaatttcttgtttgtcttcattactttttgttgtaaattcgggaacatctgttaatatagactctttaccattaatagtccatgatattttaaaagacccttggctatacactgtattcggtgtcagtttttcaattataattttagcggatgcacctgtaattttttctgaagattttaataatttacctttggaatcatataagtttaatgttctctccacaaattttatctcctttactatattttgtacaattaatataacaaaaaaacacctattagtttaaataggtgtccgacagagctcccgtacttagattacggttaataatattttacgacaactatatgagaccctctgtcgttgaaactcttgtcactgcgttattccacaagatattttagaaggtagcttgtggaagaagattgtttttaaaggtacaattagcgtttttaagcctattcgatacccaggacactatgtccgtactaactattacgtcaataaaggttctacggtctcaattacctactctttattgttaaaactaaaattaagcttgagtgctctagaagccaaaatcaattaattaactatagatacggaatggaggggcactaccatccggagtctacggtcagatacaaagcctctgccgggcaacatacggtatctctcgtacatcaggttgactagacctttagagtttttcactccttctcttataaccagtaacttaagagaaataggttttacttagtagatatgaaacaataaatccacatacaatattaaatcatagtcaagtgattgcacatatgtctaacacctataagttttttgctagcctggtatatggactctgcaggattcgaacctacagtcaaaccgttatgagcggttggctttacctttaagctaagagtcctagaaatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcttattctcattataaggttaaaaaggctaactgtgtttagcattatataagaggctttagttaactactatactaataatataccataaattatacttaatgtcaagttaatttatcaattgaatctataatttttgatgtgctacgtatatctgcttctttactatgtttaaggagatattttaatttcattaaaaaagaatttttttctttttctataatatcttctttatcatcatattctgaaaacataatgaattctatacctatactatttctattatgtgaaaacatatttatagaaaaaggtgaatcaaaatttttatcatctttattaatactaaagtcttcagtaacctgtaagtcatttatttcagatatttcaaagtaaccattaactcttttaagttcaatataactattgtatctaaagtaacgttgttcttctattaacttctcttttgttatataaggatattcatttatgaatataggattacttgttccatagttatctctaatatattctgcatcctctagggaatcagtataacctaaaatttcataacttgttgtatacactgtatcttcttcccacaagtcatagtccatttcctctatttcttcttctaatatataaatttttttcatatattactcccaaaccccgataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcggatattgtcctagcattcttgttccattttcattataaaaagtatattctactacaataatattcatcatatctacatatatagcttctatatacggtgtaatattttcctcttcttgtatgtgtttacctatgatatcatataataattctgagtgtattcgtttatctctcattatagacctccgtaaggaattctacagttttgtctttcaaagatttttctactaattccatagcatctttatagtgtttgatattagattcattagacttaagtttatcttttacttcttgaattaggggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagttaattctcctttttttagtatattattaatattaccgataacagaatatgctataggcttaaaattagctctaacataagttaaaaatataaaatcatcataaaataaatctaaaacagttttattgaatctagtatttttagcttgctctaattgagcacataaattaagaacattatcaaacccactttttagaactaaagagataaatctttctactgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaagttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagcaatcctccttaataaccatgtttagttacccaccctgctaaagcatccatagctatatcatattcttcttcatttttaattcttataattttctctatttcttcctttgcttgcttagaactaataaaatcaatatcagtatcctctaggttagttaattctaagttttctctaataaaattcttttgacttggtgttatagaattaactcttacattttcgtgatttagaaattggtagaagtccatattactcatcctttttaacgtattctgccatatcttttaaaatacttagtacatactctaaatctctatattggtcatctaacgaacctataatagcatatggtgtcatatcccaggcatgtgcacagtcaaaccctaatactctcttaccctcatagtcataatcatcgtaagtgatacctctatgggcacgtctttctaaggagtcatattctttttcattgatatctgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataattagtcatctcctttttatttatatctttactatacactattttttatattttgtcaacaaaaaaaggctactaattaaagtagcctaaatattaattatttagcgttataagaccaacgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttattcctcctaattattcttacagtactaatatatcataggtctttttctaagtcatttttaaaagtttcctcgtaagaactagcgtaagtaacctcataacccactacgttagtatatcctacatataatgacttataattagattttatcttaatatcttctgattgttctagcttatttaagacttcacctaaatcatctgaagaatagtgttcattatctattgttattgttttaccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattactaatataagagaaaagcagacttattaaaagtctgcttctgtacctaattctaatcttctatttttcatatgaggaatcatttttttatctcctgttaatagagataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagttccatcttcattttctttaaatttatgagcatcataaacttctactttatcacctaatctcaaatcttgagttaagttatgtttaccaataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgggttacagttaagttatatgacccatcactaacatatcctaaatcaatatcatgtctaaaagccaaatcttctaaatgttctaataaatcgttcttttcattatgtttttcttcttctgtattatttttaattgggttaattaattctgtacaaacaatatcatacaattcaccatctgtaacctcatagttcttttcaattaatacatcttgtattttattgattgaatttgtaactactttcccatattcttcttctgtaaacttacatttatctaaatcaacatctgtaattaattctgcaatccatttatttaaaattgatactgccattgttcgagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaagtttaatcaggtttttcatagttactctaactccttaagtttattttttactttctctttatcgtacttataatctttactagagttttcatttttttctttctcttcttcattaagttctctatactgagcttcttctacctcttgttctttattatcgttatcttcttctgctttttgaatttctacattcttactactaccatttaccttttttctaaaaagaaaccaaagtattaataaaatgatgagtaaaataacaatgctcaatacaacagcccaaatattattagccattacaacctacctccgaatagtttttttacagctcttaagttttcagatgaatcgttatttatatcaattcctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcatatcctgaatttgataacttacctaagtaaaggtttatactatatccttttgtttctaatgtttgaatagcacttaacattatagcccctctgtaagcaagattttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatctgatgaattatctctacctgaaactctattcttttttaaagcagaaaagaaatcaggtagaccatcatatttaattacatttaattctgagttatctattaatcgtctacccattgattttcctcctattctaatcctaatttatccataattgtatcaaagtccattgaatcttttgatgtactatcagattttctaggttcctgcttaggctcttgttgcatacctaaaagctttcttgttgcttctgtgtatctgttaccctcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagttaactaggtcttcattgcttgataactgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgggtttcatgaaacttaccatttgcatcaataaatcctgttaatttaaattcttgagtaattgcattactgaaataaaaatctaaatctagagcttctgctacttgttctaatacatggttcttacctgaacctgctccaccttttaaaaatactggaatattttggttaactaactttagtatatcttggtatctataatggaagattcctgagatatctttaattgttttttccttcttgttgtaattcaattttaactggtaaattactaagttgttcttctacatattcttcaatttgttttttaacgtcagtaataataatttctctactctcagttcctgctttctcaacaattgcatctacaattgcttgttcatacggattagagtttttctctcctagtttgtctgccaagtcttttgttgtttccatttgttgttctaccaatctctctaatctttcaatagtatcttgctttgccatatttatcattctcctttgatttgttatacatttattatattacaagtatttgtatttgtcaacaactttctaaaactttttttagttgttaataaaaaaaaataccttacacctataacttaacatagggtaaggtaattgtcaacacttttattaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcctaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttatagtgttcaggtaaatgtgcatctacttgtatattataataatcttctaaaagacctatactttcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaaacaccctgcttggctacaagcaaggtgaaaaaggaaagatattatggaagtgtactatctaagtacacctcataatataacagttttccttgctagttattacttattttttaaggtcttcttctttgacaaacactccattaataagcttaccttttctgtcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataactttaacatttgaccttcaggtttacctgtttgtaaatttctatcttttgcccattgtttaataagttctactttttccattattctatatctcctttaatttctgtatctttgataattaggttatcagagtcacttgttacatttaaattatcttcaactaattcatgtagattattagtaatatcttcttcatacctataacctacacgaacataagctttaactctgatatctatattaacataatcttcttggaatttttccatttctaacttcctttattatatcatattatgatactattgtcaattaatctgagtagtttcctttagcaagttgatactttttgtgtaattcttcatataattctctcataccttcatagtttctcatatcatcttccaagaaactaaggtaatctaataatacttttacatcctcaggttctaaagttataactggttttaccattaggcaacctccttaaattcttctttatttattttcttgatatctttttctaatgcttcttttaattcattaggtaatttataggcatcaattgattgttgttgacctaatacataaccattatctgtaatacgtatttccactgtaaaccatgaattatctaaatcttcttctaatcttgctaataatattaaacaactattttttagaattctgttagcatacccaccaacacaatgagataacattttaccttcatctttaagtttacttacagtatctgcaggaaggaattttacttttctaccatcttttaatttataagttttatcaattattttttctaatttattatcatatttagctttaagttctgcatcatctaattgttgttgtatagattgtttctcatctgtaactatatcatgttctagttttagtgaaaatggtgttaaactaacactctctaatgttctataaccttctcttattaatattgataaatcatgtaagtaatctaagtaatagttatctagtgcatatcctgttatacgttgtctgtcttgagcatctacatctaaatagtgcgtcatctttttgtaattagcaaaagatatagataatatttgattcacaataggtttaacttttaaagcatctgtaacatctcttgaatctctaaccattaaaaaggtatcgtcaaacaattggtgtaaattaacttcattgtgtaaatgattatagtgcttatagagaatattagcaaatcttaagtaattaccttgctcaaatttatttaaagttagtaactttttataagtctgttttgtaagattgaaggcttcatgaactttccatttaggttttttaggtatatggaatagtaatgcatttctttcaaataacccaaattcttctaagttatttattttatcaatatttttaacaatatctgttaaagttattaagtaattagaagttgaattttctcctataaaaatcctatatttatctcctctataatttatatgaccataaacatctgtattatcaggacaccaactagaaaaatcaaaattatggtgctctaatgtttgttctattatctttattataattcctctagttaagttaggttgtgcatagttttttaaaataacatttaataaaacagataaagttaattcattcttatattcacttttactaatatcatctttatataggtttaaagttatttctttattaacaagactatctgttaagaaaaccttaacttctcctgttttaacgtcaaatgaacttttattttctaaaacccatttgttacccatattatgtttatctctaatatgtttaactttaagaccaaaagatgaatagttttcagtacttggatgcatgtaccaaacacggctatataattcatctgtcatagcactatagtactcactagaacctttttctatatcttcattcataacaataatagatgactttataagaccatatttaccttggtctagtacatccataatatcattatttaaactatctactacttttttatattcttctaattgtctagattcattcctccataaatggtcattaccttctagttctttaattttttcttcaacataaccttttgattgtatacgtcttctactcttatcaccatatacaggaaaatcttttctttcttctctattagattcaatatactctttgtaacttcttcctttattatcatcaactacaccttcaactaatttttcaactgtttcataagggttaccttcaaagtttgttacttctttattaccacatagggctaaaaataaatgtatttctgtggctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagtccttctaaatgagtttcgtatataactttttgaattttatttaatggttctaaatctaaattcataataagttttttatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataacttcttctttcttttctatgctcatttataaacctcctggtctactctacacaaacaagtacgtattctaaattagttaaagaaactgatttaatattgtttaattcttgtaatttcttaatttccacatcatagttcttacttatagtccataatgtctctcctgctcttactttgtgataatatttatttccctctttgataaggtcattcaatattacctacccccttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctaaggttaaattaagacctacagatactatttgaaatactgaagcatcagttaataataagttgtaaaaacttatacctactgtagctacaattaaataccaaaaatagttactaactcccttgacactttctgctttaactaatgctactaaacctggtatatatcctactgtaattaatatagcatataatatacttaagtaatgtgataaattatccatcttgttcccctaatttctctaatctattaataacttcttcccatgaaataaatccttctccgtctgttagttctaaaaccataccatacacaaattggttcgtactaaattcagctctgtcagggtcattgtatggtttaccatgtccttgtctaatatccgagcagtagattaatacgggtttatttacaatgttttcaagtttatctactattaattcttcttcagtatttaatgacgtttcaaacttatttgtaaaataattaaaatactcttctccattatcatatatatggttaattgtttcttctgcttgatgtttcatacctaataaaataccgagttctgcaattgttcctaatccttcattaaggatatcaaatacaaaaatatctgattcttgcatagccttaaagtcattagttaaaatacgttctgctagcttagtttgttctgcattagctttatcatttattgacttatctttgtgagggctataaggagttactcctacaatgccatctacttctttatgttgtttatctctgtaatctaccatagcttcatttaggatatgtccacccatataaattactttgtctttaattttattacccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagatactagcaaagttttaactgtttttaaccctaaatgatgtgcaattacattcatgtcttctactgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacgcttgctaaaaatgctaatactactaaaccaggtaaatttaaaactgttgataagaataatgatattgcacttataacataaactagaccgcttagaaataaagttaataatacaattgttataagtttcaccaaccaattgttattaataaataccttagctaaataattcataaaaaaatcctccttagttattatagaataattataccataactaaggggatttgtcaacatattattttaccatttaaaattatctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagaattttttgtatgaacccttgtaagaacttttttaagttcactacgtttaaagttctgtgcttcatttataattatagtagcatctcttagatttccacctcttaggaatagatgggatatttgagatacccaacaatctcctagtttatcttctttaacattatcttccatcattaacatttcagttatttgttgttcaggattcatattaagttcaataagggcatcatgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctattactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaacactttaacagaatctacaactacactgtagttactaatagtaggatactctgtataaagtatttctacattagtattcatataactatcaattacagagttaactgtatctctttttagctcagatacattatgttttcgtatagtaggaaattcttcatcatattctactaattcttttctatctgtattcaataacttgtctaaagaggacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagatgcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaaagactaagaaattaatcttagtcttaatatattaataactattatgtgcgttgtggtatgcaagagctcctgatgttgaaccgtaacggtcaatcatatattgttttgcacctttagtttgttctgctatagaaccaccactccatgatttacctaatccttggaataatccttgagctcctgatgatgcattaacagcattagggttcattgtagattcacgcatagcaatttcaatcattgcctcgtctccacctgcttgtctaatctgttctgctacagagcctcctgtagaactagttgattgtgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccatcactaaaagagaaatcataattacctgcttgaattggttttgtatttacttctgctgaatttgatttagcttgttctgctaacttattataatcaatttcgtctgcactagcttcatttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaagagaggtaattatatttaccactctccagtttcattatatttatttattacattatctcttaattctatagcctcttctaaagattttgcactaaaatatttaactttattttttcttacaatttgtatattatatacattatttgattttttgtatatattatgtgtacttttctttcttatattagttgagttttcagacctagtagaccacttaacattaccaggttcataattaccatcattatttattctatctatttgataattttcattcggagggtctcccatatagtcgtagaattttttaaaatcattcttccattcttcacatatttctataccccttcctccatagtttttataatttatagcgttaacatcgtaacaacgctgtttcatacctaaccatctttggtacattgggttactggataatccatgggtagtattcctttctctcattaactcactatgaattttattactctcacacccacaagattttattttaccttgccttaaagtggagcttctaactattattacttctccgcattcacataaacattcatacattttacatcttgatttatccctcttactagactcttttataacttttagtttattaatagtttctccaatcataatatctcctcctataataaaactatagcataaaaaaccacctatgtcaataggtggttaaacatattatttatttaagtttgtaataacactatctgaacctatactaataggttgttttccattccatttttcaattaattgttgttgtaaaacttcctctgttaaggattcacttctaatgtcattggctttcttttcaccttttgcttcaatttctttctttttagcgttttcttctgctatttgcttatcaactttagtgcgctctagttcttggtttgcttttactctctcatcaattgctttttgagtatttttatctgcagttgggcttgataatgcaatatcatcaataataaaaccttgcttttctaaattatcattaagtttatttaaagtatcttgtttaatttctcctgtttttacaccaaaagcatcaattacagagtacttagaaattgcttgtctaacattatcttgtactctagaacgaagataccctttttcaagttcttctatgtcagcacttccgaatctattaaaaaggtttactgccttagttgcatctactttataagatacatcaatgtctaatttaatatttttaccatctgaagttgctacatttaaatctttatatttatgtgtttgtgttttagttgggtatttatttaccttatcaaaaggtgctgttaaatgccaacccggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaatagacggattttaaatccgtctaaatttatattctatttgaatactccccaggcaacgccaggtatttgattaggtggaacaccttgacaagttctaacagggcaatatactctgttaccgttgtaagcattataacctatccaaatgtgacctgcttggatacaaacttcgtcatatacaattgtagcccctgccggtaagttaccgcctactggagcatttaagaatggagaacctattctagttactataggttggttaccattgacaaatgttgcattttccggtttataccaagttccgtactggttctttttccaagaacctgtaactggtctagttgccggtgtacttgcgctacttgttttaccatctttaactactgtagaacttgaagttcctttatccatgtagtttttaatttgtttaatgaaataatcttttaatttattcattattgcttgtgatggtcttccttgtgttactggattaaatcctgtatgaagaaccatagaacggtgaggacaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatccgattattcaataaaagacgtaactcctttaccggttctcttatgaactccttatagtttcctataagactagactatatcttcaccctaattttgttaggggttctccatttcgatttaagggattctcacccactccattaacttgagccctactcctattgacgatttatttttattggcactcgtccgagggatagtcgttgaaccttaatattgtttccaaatgtatccgtaggctgtttttctctctcctttgatacatcttcctatattaccacttcttttattagaaatacctaagaactctaaagcctcttgagctgtgtaaaagacattcaataaattaccttctaagtcatactgagctatattataatttatttcattttttaatcctgtctttattgcatgttctctgttctcggaattagaaacccattctaaatttcctacactattatcatttttaccatttaaatggttaacttgttctttattatcaggattaggtataaaagccatagcaactaaacgatgtattttaggtgaatggtatcgtaaccttacaaacaagtaacccttgttatttttttgaagttttaactttttaggctctttacctttataagatattacttctcctttatcagtaatagtgtaattttcatatatttctaatccaggtatttcatttaatttcttttccataataacatctcctttacttaagtatataggaaagttattatgttgtcaagtagttttttaaaacaatattcttggatgctgattagcatagcttgatagccttagcctcccagtcaattaaaagaactttcattatacattactgtataacagggcaatttatttacccgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggcgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcatcaatggctcctgcttccattacaccaaatgatgggtcataacttgtagcttttttaactctgtaagggctatctactgttccttttgcataagcatctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagtgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctataatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattctttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctacttatactgataacctctattatctaacacatttctgtgctccaactacagttagtcgttacagcgtatctttctaggattccgctaagaccctaaaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaatttcaaaaaaattatagaagtagggacgtttacctacttctatttaatttacacaaggatgataacattgttattgttttatactggaaaacaatgtaataaaaacagtgatgtgtaaggtatttgttttattgttaattatattatagcatatactgatacctttgtcaagttaatttaatactttttttaaaacattagttatcttttgttagttcctcctgaatagcatcccatcttctttctgcttcactacgattatcttctatatgttttgtagttttacaacatttgatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaagaatactttaatatcaagggttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtatcagtacttacaggcaaaaaagtacgtatttagaaaataaggagctctcctattatagttatatatatttattactattattaattactatttaaatatataattataattaacaatgttagaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttcttagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaatgggctagtgcatctttaaactctaacttaaggatatccttatatttagtcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaataatagaaagtaattatggtataacagcagaagagataaaagttagggctaaagcacaaagaagagtagaggaagatagtaaaaaggaagattacaatgaaaacaaagaaagaaattaaagaacaaaggaaagaacttaaggatggtgctacatctgtttctttagtaaaaaagggagataagagaatagctagccctagtagaatttgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaacaagaaaaagttagaagaagaggatacaagaaaatatatagctgatgggtttatgaatggtatcggtaaattaatgtacgaatttaataagaaagtagataacaaagaaatagaagttaaagacccgaatgatttatacaaattatttgtgatattctctcaaatgcaaaatatggtcaatgaaacttctgaaggaggagcaatacctcaactatctagacctcaacaggaattatttgatgagattacaacagaagatagtaatggagaatctacagttgatttacagaagatatcagaaatgtcagcggaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaatccttctacctatatgcttaagtatcatacactgagagggcatcctataacttttagtattcctaatagagatagaagtaaagcacaggctcatagaccttggcaaactaggattgtaaatgatactcatcctaataaggctgtaataaaatcacgtcagttaggtcttagtgaaatgggtgtaatggaaatggttcattttgcagatatgcatagttatgctaatgcaaagtgtctgtatacattccctacaaacgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtactgtagagggtgtggatattgactatttatctttagatgagtatgacagggtaaacttattagcagaatcgtctgcattagaatcaatgtcttcatcaccttttaagattgtgagaagatggagcacaccttctgtacctgggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacagaatggcagttaccaatttgtttgtcaaaaatgtggtaaaccactagatagatggtataatggtgagtggcattgtaagtaccctgagcgtacaaaaggtaataaaggggtacgaggatacctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataatgttttaaaactcattaatcattttggaaaagataaagtatttggatgtacttataaatcttctcctaaatctaccggacaattaagacctgaatttaatgagaacaataatagggttacagtggataaattaatgcagaataaaagatatgtacaagcacttaagacaaaggatataagtgtttatagtacagtagatgatgatttaaaaactttcttaaaacattggcagaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatactttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagggctatttctaatggtgaagaaggaaaggtaaaccctaaaaaggtagcaaattcattatctaatttaagtaaaaaaggtgtagatgtatcacatattaatacaaactcatcattgtataaagagtttgttgatgataacggtgatacattaggaattacatcttttaaacgaactgaaaatgatataatattagaatcttatgcaagttcacatgattcagatggtgtaggagcaagagctattatggaattattacgtttaagtattaaggaaaataaaaatgcagttgtgtatgatatagaattacctgaagcagtagagtatttaaaaactttaggatttaaacctaataaagatggatacatcttaagaaaaaaagatgtaaaacaattcttaggtgattatagtgattttatttagcactatagtcatctattctattgtatttattctatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagcaaagaggagaaagaagatagtattaaagaatttagcagtttattatgtgaaatggtaaatagactatataagtcttataatgtatttagacaagaccctatggatgaaactcaacgtctagatggctctttaatggtctttcaaagtagattaaatgaccctttaacaggagatttacatgataagatgtataaacttgctttttcaaaacgtattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaacctgaacctgaacctgaacctgaaccatctgaaccgtctgacaatcctgatgaaaatggaggatgggaaactgaaccaactgaacctgagtcaccttcagagccggacgataaagtggacgaagaagataaaaatgaagatactacagatgataaacagcccactgaacaaccggacgataacaacatagataatgaagataaaactgaagaggagtaattactcctcttttttgtttgctatattaaataagagctaaatataaaaaaattgaacattacggtggtgaaaactttgttaggaatgaatattataacgtcactatcagtagtatttacttgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttactataagttttataggtgcaatacttggaggaatttggtacaagatgatgaaaattattaaaaagagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaggtaatattagtagataaagataataatatactattagaagattatgatattgttatggaaagtaagaagatgttttattacattgaagaaccgttcgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaagaacgaacataacttacatgatgttttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaagaaatgaaacgtatagaagattttattgttaatacaggtaaagataaagatgtagatagagattcatttcaaactttctgtaagaaaattgttagagatacttacatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagagttagctatgggtataagaaaccctagaactgaattatcttcttcaggatatggattatcagaagtagagatagctatgaaagagtttattgcctacaataacactgaatcatttaatgatagattcttctcccacggtggtactactagaggtattttacagatacgttcagaccaacaacaatcacaacatgcattagagaactttaagcgtgaatggaaatctagtttatcaggtatcaacggttcatggcaaataccagtggtaatggcagatgatattaaatttgtcaatatgacaccaactgctaatgatatgcaatttgagaaatggttaaattaccttatcaatattatatctgctttatatggtattgaccctgcagaaattggtttccctaatagaggaggagctacaggttctaaaggtggttctactttaaatgaggctgacccgggtaaaaaacaacaacaatctcaaaataaaggtttacaacctttacttagatttattgaagacttagttaatagacatattatatcagaatatggagataagtatacattccaattcgtaggtggagatactaagagtgctactgataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaaggcaatgaagatgaggaagttgaaaaatcagctaaagaatcaaaagaccctgtagaccaaaaagatactaagacagaaaataaagacaacgagaaacgtaaaaataaaaaagataaaaaagaagattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagtcaaaggattaactaaagaacaagaaaaagaatttgccaatgttccaggttttgaatttgaagaagaaaagaaaactactagaaaacaatcagcttctactagtaaagaagaagagcctaaggaagaggaaaagaaagcctctactagaaaaactacaaatactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacacatagatgtaagtgagatagataatttaacattagctgattatggatggtcaccggatgcagttaaagcatatatgttcggtattgtagttcaaaatcctgatacaggacagcctatgggtgacgagttctataaccatatattggaaagagcggtaggtaaagctgaaagagcattagatatatctatactacctgacactcaacatgagatgagagattatcatgagacagagtttaatagttacatgtttgtacatgcttacagaaaacctatattacaggtagagaacttacagctacagtttaatggtagacctatatataaataccctgctaactggtggaaagtagagcatctagcaggacatgttcaattattccctacagcacttatgcaaacaggacaatcaatgtcatacgatgcagtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgccccctgagttagaacagttagttataaaatatgcattgaaagaaatataccaagtatggggtaacttaattattggtgccggtattgctaataaaacattagaagtagacggtattacagagacaataggtactactcaatcagctatgtatggtggagctagtgctcagatacttcaaataaatgaagatataaaagaactattagatggtttaagagcttactttggatataatatgataggattataaggagggttagaaaatggaaaaaccgtatatgataggagctaactctaaccctaatgttattaataagtcaacaacatatactactacaacacaagcagatgaacaagataaacctaagtatactactagactagagtttgatacgattgacatgattaggtttattaatgaccgaggtataaaagtactatgggaagaagcatatttctgtccttgtcttaatcctgatacaggacatcctagagtagattgccctagatgtcatggtaaaggtattgcatatctacctcctaaagagacgataatggcaatacagtctcaagagaaaggaactaaccagttagatataggtatattagatacaggtactgcaataggtaccactcaattagaaaagagaatttcctatagagacaggtttactgttcctgaggtattgatgccccaacaaatgatttattttgtgaataaagatagaattaaaaaaggtatacctttatactacgatgtaaaagaaataacttatatagccactcaagacggtacagtctatgaagaagattatgaaatcaagaataatagattgtatttaaatgaaaaatatgagaatcatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgtcattgtactacaagacccttataaagttaatgatggtatagaagaagacctagaaattcaagtagatgaccctaaggcttcggcatctaatcctagtaatttaggtggattcttcggaggtgcatttaaataatgccagttcatggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttatctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttatcaagatatgagaactttaaaagtagataaaggaacaggttcagtttcgaagataactgattacctagaaggacgtaggaagaatgtaagccacccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagatactttagtcgaatcttctacagcaataagagaagatgataagttagtttttactgtttctaaaccaataggagagttaataaaggtagaagatatagagtttgctaaatacgataatcttcaggttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgagggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactattcacaagctaaacgtttattccgttcaggagaattacttgatgcaatagaattagcatggggttctaaccctaactatacagcaggacgtattttagctatgcgtatagaagatgctaaacctgcttcagcggaaattggcggattaaaaataacatctaaaatctacggtaatgttgctaacaacattcaagtaggattagaaaagaatacactaagtgattcattacgtttaagagtaatattccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagcaaattagataaaattgaaaatgcaaatataaaagataaagctgtatatgtaaaagcagtttttggtgacttagaaaaacaaacagcttacaatggtatcgtatctttcgagcaacttaatgcagaaggagaagtaccaagtaatgtagaggttgaagcaggagaagaatcagctacagtaactgctacttcacctattaaaactattgaaccgtttgagttaactaagttaaaaggcggtactaatggtgaaccacctgctacatgggcagacaagttagataaatttgcacatgaaggcggatactacattgttccattatcatctaaacaatcagttcatgcagaggtagcttcttttgttaaagaacgttctgatgcaggagaaccaatgagagctattgttggtggaggattcaatgaatctaaagaacaattgttcggtagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattcaaaccactacgtgtaagttcattagaccaaatctatgagtcaatagacttagatgaattaaatgaaaatggtattattagtatagagtttgttcgtaaccgtactaatacattcttcagaatcgttgacgatgtaactacattcaacgataaatcagacccagttaaggctgaaatggctgttggggaagctaatgacttcttagtaagtgagcttaaagttcaacttgaagaccagtttattggtactcgtactattaatacaagtgcttcaatcattaaagactttatccaatcttacttgggtcgtaagaaacgtgataatgaaattcaagacttccctgctgaagacgtacaagttattgttgaaggtaacgaagcaagaatttcaatgacagtttacccaatcagaagcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagacatcattgatattttagtagtagataacttaacgaaacaagttattatctcatatcatggttgctctgcaaataactacaatgaaacttggcagacaaatgaaattgtaacagaagaaatcgagtttagttacttaacagcaagtgacaaagcacgtacttaatagattagaccaactaaaaagttggtctttttttattgacactttaaaatttatatgttattataaatataataatttaaacaggagatgtactagatggcaaataagagaaaaacaataggaaaaatgagtaacacaagagcaacatggaatattaatccggtaactaaagttaaaaaagataaaacaaaatattctagaaaaaataaacataaaggtcttgacaattataattaactaaggtatattattagtataacaaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaggttaaaggtaaaccaacaacaaatatacctaaattaataggttttatttttaaaaataagtttgcctacgaaaatatcatagagtacaataacacagattataatggtaatattgagaggagaattgttgttaaacatcctaaagttataactgtagaaggaaaacctagctatcagtttttgacaattagtcttgaagatgctagagttattacggtgtggtataacagtgtagatgatacacatagaacactagatttaaattattatagtaaagacttgacaattcaataaggaggtattataatgggtataacaatagtaaatagttattttattctgtctagcattttcctcatcatattaaccatattaaatggtaagggtacagttacaagggaatcattaactatgagtaaaatattagtagtaataacatcaattcaatttttagcatgtttaattattaatggtatttattggtcactaaaatttatgtagtagaactagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggcgttaatgatacttgggaaaaagaatataactttgaagaactagacttaagatttaaagttaagattaaattacctaatgcacgagaacaaggtaatatctttgcgttacgttctgcttacttaggtggtatggatatgtaccaaacagaccaagtgattagagcatatcaaatgttagctaccttacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctaccgagcaaagatttaaggacttagacgattatcagatagagtttattattgggaatatgaatagagatgtttatgaacataataaacaacttaaacaagctcaaaaaggtggaaaattcgatagtcaattcgaagatgatgatagtagttggtggaatgaatctcatgaagactttgacccagtacctgatttcttagatgctgatgatttagcacaacagatggaagctaaattatccgatagagataaggaagaaagagctaagagaaacgatgcagagttaaatgatgaaacagaaggacttactacacaacatctagctatgatggaatacatcagacagaaacaacaagaattagatgatgaagtaggaaatggtaagactagtgaagatgacgctactatatcacaagatagcgttaataaagcactagaagacctagatgatgactggtatatgtaaagggtggtaggtgatactaccatccttatttttttaaaatggatggtgaataatgatggcaatgaatgacgattatagattggtcttgtccggtgatagttcggatttagagaatagtctaaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgctagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgtttgacatatgaccaaggtgcacgagttagaagtgaactaggtaaagtaagttcttatgagagccaaagaaaacaaaaccaacgtaatttggaacaagcaagagaacaatatagcaactatagaaaccaacaacaagacttgactaaacgtagagctagcggtcaaattaataaggcacaatatgaacaagagttagcttctattaaacaggaaatgaaagctagagaagaacttatatctaactatgagaaattaggagcagaacttgataaaacagttcagtattataagggttcagttcaaaaggatttccaatctagagacgtagaccaacaaagaggaacatttggtagaatggttcaagaacgtttgccatctattggttctcatgctatgatgggtactacagctatggctacaggtttatacatgaagggtgcctcactaagtgaaactaatagacctatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggtggagtaaattctgataacatgaaggaaatgcaagatgcattcttaggtggtattaaacaatcaggcatggttggtcgtcaagatgaacaacttaaagcactaggttctatagcggaacaatcaggagaaggaagaactctaactaaagaccaaatgagtaaccttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatagctactcaaatgggtggcagtgaaaaagaacaaaaatacctatttaatagaagtatgaaagaaataggcgctaacctaactatggagcaatctgatgaaatatttaaggactctaaagaaggaaaactgtctaaagaagagttagctaagaaagctaagaaaatggaaaaagaaggtaaaaaagaaggagaagataacgccactgattataaagaatctaaatcaggaaaaaatgaccaaaataaatctaagactgatgataaagcagaagatacttatgatatggctcaaccactaagagatgctcatagtgctttagcaggtcttcctgcccctatatatttagctattggtgctataggagcatttacagcttcactaattgcatctgcaagtcaatttggagcaggtcacttaattggtaaaggagccaaaggacttagaaataaatttggtagaaataaaggcggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggctttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtattctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaacggagataaggatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggcgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggggctagaaaaacaggattagaaaattttgctaaatctaaaggtaaaaaatctagtgacatggatgttcaattagattacctatggaaagaaatgcagtctgattatgaaagcaataatcttaaaaatgcaggttggagcaaaggtggaagcttagagcagaatacaaaagcatttgctactggatttgaacgtatgggagcaaacgaggctatgatgggtactcgtgttaacaatgctaaggaattcaagaagaaatacggaggctccggtggcggaggtggtggaggagccctatcctctacttaccaagaagctatgagtaatcctgtattaactactggttctaattataggggctctaatgatgcttctaatgcttctacaactaacagaataaccgtcaatgttaatgttcaaggtggaaataatcctgaagaaactggagacattatcggaggaagaattagagaagttctagatagtaacatggatatctttgcaaatgaacataagagaagttattagtaattttgtattgacacaagagtagtatcatagtatactactcttatacatataaaaaataaaaggaagtatgtgtatatgcgtagaataagaagacctaaggtaagaatagaaatagttacagatgataatacatttacattgagatttgaagatacacgagactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccctaacgataaagaaggaaaacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattacctgaagtaggttggcttattgatggtgatggagataatgaagtaaaatttactggtagctcagctcatgaagtaatgactggtattatacgtagatttataccttatatgaaatataactatactgaaaaaacatataatacaattgataactatcttgattatgatgatttaagtagttgggatgagtttgaaaaacttacagaagtttcagcctttactaattttgatgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttctaaaccacaattccaccctgaattaactgatagatatggttatactaaatttgaagtagaaaatatttatcttagtacaaaatcaggttcagctactgaggattcagattcttcaggtgatgataatggcacagaacgaggaacttattctaaaattatgaaagatttaagtaactatggaagagataatatatctaaaggtatagataagtatacaagtaaattatcttcaaaatataaaaacttaaaaaaagcccaagctaaaaaaattatagagaagtttgttaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttattagatgaatatattaaatataaaggagagccacctaacgatgaggcttttgataaatatcttaaagctattgaaggtgttagtaatgtagctacagacacaggttcagatgcaagtgatagccctttagttatgttttctagaatgctatttaattggtatcatggtaaccctaacttctatgcaggagatattattgttttaggagaccctaagtatgacctaggtaaaagattatttattgaagataagcaacgaggagacacttgggagttctatattgaatctgtagaacataaattcgattataaacaggggtattatacaactgtaggagtaactagaggtttaaaagacgctattctagaagatggtaaaggtagtccgcatagatttgcaggattatggaatcaatcatcagacttcatgggaggtcttatgggtgaagatacttctaaagaacttaaagaaaaaggtgtagcagagaaacaaagtagtggagataaagatggtggttctgatagtggtggagctcaagatggtggctctttagattcacttaaaaaatataacggcaaacttcctaagcatgacccaagttttgttcaacctggtaaccgacattataagtatcagtgtacatggtatgcttataatagaagaggtcaattaggcatacctgtgcctttatggggggacgccgccgactggataggtggtgctaaaggagcaggttatggtgtaggtagaacacctaaacaaggtgcttgtgttatatggcaaagaggagttcaaggaggtagcccacaatatggtcacgtagcgtttgtagagaaagtattagatggaggtaaaaaaatatttatctctgaacataactatgctacccctaatggatatggtactagaacgatagatatgagttcagccataggtaagaatgcacaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccttatgttggagtaatacaaagccttaaccctcagcatgttcagtatgaatcattttctaataatggttatgatatagaggcagaattaagtttcaggaaagtaagttatttagttgataaagggtctatacctacagattctttatctactttaacagttcatttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcatatcctatgaatattaactacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcggatgatttaaatgtaaaaggattagttttagctacagttagtaaaattaattataaatatcaatcagtagaagttaaagttaacaatttaactctaggaagccgtataggtgatgatggtagcttagctgtaccttatcctaaatctttcataggaagaacacctgaaggaagcgtattcggtacaaaacctcttattactgaaggttctgtagtattaatagggtttctaaatgatgatataaatagtcctattattttaagtgtttatggtgataatgaacaaaataaaatgattaataccaatcctctagatggaggtaagtttgatacagaaagtgtttataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggagttttttatgatgatggcacgccggataatcatataactactttatttatatctgaaagaggggatataagagcctcagttttaaatacagaaacacagaaaagaactacacaggaaatgtcaagtgatgggtcttatagagttatcaaacaagatgacgatttaatgttggatgaagctcaagtttggattgagtatggtattagtgaagataataaattttatattaaaaatgacaagcataaatttgaatttactgatgagggaatctatatagatgataaacctatgttagaaaacttagatgagagtatagcagaggctatgaagaatttgaatgaaatacaaaaagaactcgatgatataaactaccttctcaagggtgtaggtaaagacaatttagaagaattaatagagtctacaaaagagtctatagaagcttctaaaaaagcaacttcagatgtcaatagacttacaactcagatagcagaagtgagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatctcagatagaggagaacatataggtgctatgatacagttagaggaaaatgtcacagtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgaccttatcttatatacaaactaactttacatctctcaatggtgagccgataccatctcttgatgatgtactaaatcattttggaacaaaagttaaatattatatagaaactaaacgtccgtttgatgctaatatggatagagaattattaactcaattaaaagcaaaaggattaataggaataggttcagagagattccaagtaattattcaatcatttgctagagaatctttaattaatattcataatcaattctctaatatacctttagcttacctaacaagtacattttctgaaagtgaaatggatgattgtttaagttatggtttttatgctattgcgcctaaatatacaactataactaaagaattagtagatttagctcatagtaaagggcttaaagtccatgcatggacggtaaacacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccctgagaactacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaacaacagaagagtttggtaacgttaaacctaatgcttctcaaagagtagatgagggtataaaagaattagataaaaatgctcgtaaaacgagagatagaaacaatcaagaaatatctagaagagaaaatacaatacctaaatctacaggagataatacgaacgagggtaatagacttaagcaaagcttccctagtagttctatatataatcctagacaatctactaacggattaaaaggtaatattgacaatatggcgctgataataggttacggtgatggaggtgtatctagctaatgaataattttataccacaacctcaaggtctacttagatttttaaataccctagatacagatttaacttcttctcatatgaatttactggatgaagaggtatcatttgtatctaaattttatacaccacagctacaattaagtgaattagcaaaaaaagtattgacaaatataaagacagatgatatacctgtattagaaagagaatttaatgataatacaattatccataaagctaacgatacattactaaaagtacaggctccaagaatgtatatgattctacagtcgattgtacttgaagcatatgctattgttaattgctttgtagaaaatccgagctctttaaaatacttaactgaagaagatgttagtataacacgggaaaatttaaattatgtagctgactacttaggtaactatgatgactataatagtgttgtcttagacttaagagatttagacttatgttttagtgctatagaattacaattacctctaatcaaaaaggaggctaacgtataatgagatttaagaagcacgtagttcaacatgaagaaacgatgcaagcaatagcacagagatactatggtgatgtgagttattggatagacctagtagagcataataatttaaagtacccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttctttaatgctacatcctaattacggttcagatttgcataatttatttggtcttaatatacctgaacaagctacattaatagaaatggaagtattgagaacattaacatcagataatagagtaaaatctgctaatctaattgattggaaaattcaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttctcgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacccgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcactgcagatacctgatgtagaaggtgtttatgtttatgaagaaacaggacatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgatgtattaatatatgatgtgtcatttgataacctagatgagaacattatagtaccgccacaaggaattattagagcaggagaaataaaagtagaactaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagtaagttacaatcttctctaaagacatctaccagtgaatatttagataagtttggggattggttcggagtttatcgtaagaccgatgagaaagatgatgtttatagagcaagaattataaaatatttactcttgaaaagaggaactaataatgctataatagatgctataaaagattatttaggtagagatgatattgatgtaagtgtatatgaaccttttacaaatattttctatactaacaaatcacatttaaatggtgaagaccacttaatgggatactattatagatttgctgttattaatgtctctataggtgattatttccctgtagagattatagatgtaattaatgaattcaaacctgcaggtgtaactctatatgtcacttatgatggggcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaaccatagcttaattaatagtttagatgttttaacaggttcatctagtgtagggagacagtatattaactacggatatgtaacatcatatgtttataatccaggtatgacatcttctgtaaatcaaataagcgctagtacagaaggtagaggtcaagaagtacctactgactattatatgtatactagtactaagaataacaatacagtagaacttagtatgcaaactacttccggtgtgtcttatttatataataactttaattttagggactatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataatttatctttctatgaaaaaaatatcgggagcaatataggatatataaaagattatctaaacagtgaattaaatatgtttactaggttagagataaatgcaggtaaaagagattcagtagatattaaagttaattacttagatttaatgttttattactatgaacgaggtatttatacaataaaaccgtataaagcattaatagaaaattatttagatatatctagagagacttatgtagaagcatttaaaatagcatcattatctaatggagatattataactaaaacaggttttcagcctatagggtatttaaaactagttggtaattatgaaaatacaatacctagcacaataaatatagtagctaaagatacagataataaccctatagaatctaatgaattagatgtatataatacagtagagaatagaaatttattacaatcttataaaggtgtaaatacgatagctagagaaataacttctacaaaagagtttactgtatcaggatgggctaaagagatatactcaactaattatctttctaaagtattaaaaccaggtaaagtgtatacgttatcttttgatatggaaataacaggtaatgacccaactcttaaatcttattctgataatcatggtatatatttatacagtaatactaagggaattgttgttaatggtgttaaatctatggaacgtactataggtaacaaagtatccgtaactcaaacttttacagcccctactattactgaccatagattactaatatatactggaagatatacatctgatggtaaagcatcaactcctccagtgttctttaatacagttaaaattacggaattaaaattgactgagggttcttctaagctagagtactcacctgctccggaagataaacctaacgtaatagaaaaaggaattaaatttaataatatcctaactaatatacagactttaagtattaattcggatactatcttaaaaaatgtaactttatattattcttactatggtgatagttgggtagaactaaagactctaggaaatattagtactggagaaacaacagaaaccaataacttaatagatttatatggattacagacagtagattattctaatataaatccaatgtctaaagtatcattacgttccatttggaatgttaagctaggtgaattgaacaatcaagaaggttctttatctaatatgcctaatgattactttaatgctgtatggcaggatatagataaattatcagatattgagctaggttctatgagaatggttaaagacactgagggcggagtattcgatggagctacaggtgaaattattaaggctactctatttaatgtcggtgcttatactgatttagatatgttagcctatactttgactaattatactgaaccgttaacgttaggctctagtcgattaataagtgagctaaaagaagaactactaacatcagaatcatttaatgtcgataatagaattaaagtaattgactcaatatatgaggagttaccaaatacaagcattattaaaaatggatttgttgaaagagaagttacaggttctaaatatttagattacggtttatatgagcctatagaagatggtactagatataaacttattgtcgaaggagaatttaaagataatatagaatttatatctttatacaattctaaccctaactttaatgaaacatttatatatccatcagagataattaatggagttgctgaaaaagaatttattgcaaaaccatctactgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacatatagacaagtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcaggttcatataaagtaaatggttttgaactattttcagaaggtaatgctgaagatgatgaccacgtttctgtagttgtagatgcaggtaaagcctatgtaaaaggttttaaagtagacaaacccgtatcaacaagaattagtgtacctaaatcttatgacttaggaacagcagaaaatgaaagtactatctttaataagtctaataactctattagtttagctaatagccctgtaaaagaaattagacgtgttacaggtcaagtacttattgaaaaagaacgagttacaagaggagctcaaggtgatggtcaagattttctttcaaataatacagcatttgaaattgtaaaagtttggactgaaacaagccctggagttactacaaaagagtataaacaaggagaagacttcagattaacagatggtcaaacaattgattggtcacctcaaggtcaagaaccttcaggaggtacttcatactacgtttcttataaatataacaaacgtatggaagccggtaaggattatgaagtaacaactcaaggtgaagggttaagtaagaaatggtacattaactttacaccttcaaatggtgctaaacctattgaccaaacagtagtattagtagactatacttactacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgctctagatgatggtgctatggaaggacagaaccctctaacattacgttcagtattcagtgaaggtttcattagtcttgacaaagcagacattacacatcctgacttcggaattgtatttagttttgaagatgcagaagctactctagcttatacagaagcagttaaccaacctaagattattccaggagatacaacagctcatatttggggtagattaatttcagcaccatttactgaggaacgtacaatctaccaaggtcaagcatcagaaacattaaatgttaacccttataatattcctaacaaacaaggtgtgttaaaattaacacctagtgaggataactggattgatactgaaaatgttacaatcactgaacaaaaaactaaaaaagtaactatgaaacgattttggagacataatgaaagttactatggtgagactgagcattacttgtattctaacttacagttagatgcaggacaaaagtggaaaggtgaaacttacgcttatgatagagagcatggtcgtaccggtactttattggaatcaggaggacaacgtactctagaagaaatgattgaattcattagaatcagagatgtatccttcgaagttaaaggactaaaccctaatgataataatttatatttattatttgatggagtaagatgtgctataacacctgcaactggctatagaaaaggctctgaagatggtacgataatgacagatgctaaaggaacagctaaaggtaagtttactattcctgcaggtattcgttgtggtaaccgagaagttacacttaagaatgctaactctacaagtgctacaacttacacagcccaaggacgtaaaaaaaccgctcaagatattattatcagaactcgtgtaacagtaaacttagtagacccgttagcacaatcattccaatatgatgagaatagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggagtacgctattgttattattactgagaacagtgattatacaatgtgggtaggtactagaactaagcctaaaattgataaacctaatgaggttatttcaggtaatccatacctacaaggtgtattattcagttcatcaaacgcatcaacatggactcctcaccaaaactctgaccttaaatttggtatttatacttctaaatttaatgagacagcaacgattgaattcgaaccaattaaagatgtatcagcggatagaatagttcttatgtctacgtacttaactcctgagagaacaggatgtacgtgggaaatgaaattaattctagatgatatggcatcttctacaacattcgaccaattgaaatgggagcctatcggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacagatatcacaacccgactttaataatattttagcatctatacctgatagtggtaactattatgtaactaattcaaaaggtgctcctagtggagaagctacagcaggatttgtaagattggataaaagaaatgtaaattattataaaatttactattcaccatatagcagtaacaaaatgtatatcaagacttatgctaatggtactgtatatgattggattagttttaaattagatgaaggtagcttatacaatgaaggtaatactttgaatgtaaaggaacttactgaatccacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctgatacgtacccttcagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacattcactatacctgaaaatacaatcggagcatcaggcgttaaagttaattacgtatctttactactaagaatgaattgttcatctagtaaaggtaatggtgctgtagtatactatgccttacctaaattagaaaaatcatctaaagttacaccatttattacacatgaaaatgatgttcgtaaatatgatgagatttggtctaattggcaagaagttattagtaaagatgaattaaaaggtcactcccctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccatatagagctaataagtttgttaaattattgtttactgacacagagggtattccttacacattatattatggtggttataaccagggttggaaacccttaaagcaatcagaaacttctactttactatggaaaggtactttagattttgggtctacggaagctgttaacttaaatgactcattagataattacgatttaattgaggtaacttattggactcgttcagcaggacatttttctacaaaaagattagatataaaaaatacatcaaatttactgtatattagagattttaatatttcaaatgatagtacaggttctagtgtagacttttttgaagggtattgcacttttcctactagaacatcagtacaacctggtatggtaaaatctataactttagacgggtctacaaatacaacaaaagtagcatcatggaatgaaaaggaacgtataaaggtatacaatattatgggaattaatagaggataaagaaaggtggaataaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatatttgtattatagtaaacctgaagaggttatagaaaataaaaactatgtaccaccacaaatcaatgatgatgatgaggaatcccaacaaattactgtacctaaagaacaatatgatagtttaaaagaagaactagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattacctagtaataaaaatgctgttatatcaggaactaatattttagatatagcttcaccaggtgtttactttgttatgggaatgacaggaggaatgcctagtggagtaagctccggatttttagacttaagtgtagatgctaatgataatagattagctagactaactgatgctgaaaccggtaaagaatatactagcattaagaaacctacaggaacatacacagcctggaaaaaagaatttgagccaaaagatatggagaaatatctactaagtagtattagagacgatggtagtgcatcattcccactcctagtttatactagtgatagtaaaacatttcaacaagctattatagaccatatagatagaacaggtcaaacaacctttactttctatgttcaaggcggtgtatccggttcccctatgtcgaatagttgtcgagggttattcatgtcagacacacctaatacttctagtttacatggtgtttacaatgctataggtacagatggtagaaatgtaacaggttcagtggtaggtagtaattggacttcaccaaaaacatccccttctcataaagaattatggacaggagcacaatcattcttatctacaggaactactaagaatttatcagatgatattagtaactactcttatgtagaagtttatactacacataagacaacagagaagactaaaggtaatgacaatacaggaactatatgtcataagttttatttagatggtagtggaacttacgtttgttcaggtacatttgtttccggggatagaaccgatacaaaaccccctatcacggagttttatagagtaggtgtatcttttaaaggttctacatggactcttgtagatagtgcagtacaaaatagtaaaactcaatacgttacaagaattataggtattaatatgccatagactaggagaaatttcctagtctttttttttcttgacttgaaaaggattctgtggtatactataactcgtgtaaggatataaggagattaaaatgagattaagaattaagaacttatatacctatgtagaatttgaggaggatgataaatacttaaaagatatatttttaaagagagtccatacgactataggagcaagacaagaaggatttcagtacagccctgcgtacaaaagaggtagttgggatggttatgtagatttttatgtttatgaggaagataaattccccactggacttttatttaaaattgagttattattaggtgagctacaatcaaggtataatttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaattattacctcaattagaaaaaggtgagagagtagcattcttcacaggctctacggagatattccatcagtctgcagataggctccaagagcgtttaaatattcctattggtaaagtaggtgcaggtaagtttgatgttaagcaggttacagttgtaatgatacctactttaaatgcaaaccttaaagacccaacacaaggggtaaaggttacgcctaaacaaaatattagtaaaaagattgctcaagagatattacctaaatttgaaggtggaacaaatcaaaagaaattactaaaagtattacttgataacacaacacctaaaacaaaagtagaacaaaatgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtacaataatttaatgacatgtgaaaaagctttatatcgaattgcattaacagggtctatagataaaaaagatgaattactttggatgagattgcaggcgctattcggtaatgttattgcacgaactactaataagtttttaattgatgaaggtcattctgctagaccaacaataaatattatacctgtagctaatcctaatgacatagatagaattgatgattatagggaagcttacgataaaggtataacaaataatgattttaggaataaacttattgcaaaactaacagaaaagtggtataatcaagataaaggtacattgattattgtaaacttcattgaacatggagacacaatatcagaaatgttaaatgatttagatgtagagcattacttcttacatggagaaatagactctgaaactaggagagaaaaattaaacgatatgagaagtggtaagcttaaagtaatgatagctacatcacttattgatgagggtgtagatatatcaggtattaatgcactaatattaggtgcaggaggtaagtcattaagacaaacattgcaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggggtaataataactttagttagagagtatgacacagaagaattgaaagaattcaataattctacagataatattattacttccgatttacagtatgctaaggcattaagagaaaagcacttcccttcttatagatatgagagaaaagaacaacgtagacgtactaagatagaaatggcacaatacaatgccattaaggatgagaagagaagaattatagcagatatgaatttctattcagaaggtcttccttatccttctaaagatatttttaatatgtcctatgacccggaagggttttataaagcgtacatcttatgtaagttatacgaccaatatgctatttctcatatggatgctaaacatacaagtcatcttaaagcaatgagtaaggcaacaactaaagatgaatacgactaccatcaacatatgtctgaatactatagaaataaaatgattcaaaatttacctagaaatagcgttagtgataatttctttggtagtaaaatgtttaatactttttataatttttatttaaaaataaaagataaaaatattaatgtatttaagtatatgcaaaatgtatttaaaaatgtaacattttattacgagaacggtatgcaacctaatccaataccttctcctaacttctttagctcagataagtattttaaaaactataataattatattaaaggaataaaaaaaggtgttaacagtactaatagacacctaggtgatacagacagcatcattaattcatcagactatgtgaaaaaccctgctgtattacatctacaccaactatatactacaggattaaattctactttacatgatattgatactatgtttgaacaagccttagaccttgaaaatgcctcctatggattatttggagatatgaaacatattattttactacagtataattctatgattgaagaagaaattaagaatttacctagagaagaaaaggatattattaataaatatgtaaaacaatgcataattaatgattattcaccaacaagtatttcaccttctgcaaggttatcaatgtttactatgcagaaagagcatatagtttacaataagcagttaaataaaggaatcaagagagaggatttattaccattaagtctaggaggtatagtgaataaagatttattgagtggtatggatatacaaaacttagaacagaatggtaatgaatacctatatatgagacaacatacttcaacttattatatattaagaatgtttggtgactatttagggtatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagaacaaattattgtcaatacaacaattaagaaggataaaaatattgatgttgttattattgactatcctcacttaatgagaaatccttatgctaaatatcattcagaatcagatgcaggagggaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagcggtttcttaagattgtatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatataccacttgacattttatatgttaggtggtataattattttataaagaataaaggagagattaataatgaaatttgtattctttacagatagccactttcacttatttactaactatgctaaacctgatgagcagtatgtgaatgatagatttagagaacagatacaagctttacagaaaatgtttgatattgcaagagaagaggatgcaacagttatatttggtggggatttattccacaaacgtaacgcagtagatactagagtatataataaggtatttgaaacattccaacttaatagagatatagaagtactaatgttaagaggtaatcatgattcagttacaaatagtttatatacagattctagtatagaacctttcggttacttacctaatgtagaggtttgtaaaaaccttgatactttagggtttttaggagaagaacaggatattaatattgttatggctccttatggagacgagactgaagaaattaaagagtttattaaaaataaatatgtagaagatagagtaaatatcttagtaggtcatttaggtgtagaaggctctttgactggaaaagggtctcatagattagaaggggcatttggataccaggatttattacctgataaatatgatttcattttactaggtcattatcaccgtagacaatatttccaaaatccgaatcatttttatggtggttcattaatgcaacaatcattttctgatgagcaagaagctaatggtgttcatttaatagatacagaaaaaatgactacagaattcatcccaatccatacacgtagatttattactattcaaggagaagatattcctgagaactttgaacagctaatcgaggaagataattttattagggttatcggtacagcaaatcatgctaaggttttagaaatggatgacagtatgaaagataagaatgttgaagttcaaattaaaaaagagtatactgtagagaaacgtattgatagtgatgtgtctgatgaccctttaacaattgctagtacctatgctaaacaatactcacctgaatcagaacaagaaatacttgagtgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtagtaagtaaagacttagataaaagtaaacctattttacaattccaagattcagatggagtaatagagaatatttgtaatgttgaaggtttagaagatggtctaagtaaaatgaaaaagatttttgatgatagtaattttgaaaagcattattacaatagagtagtagaccatgatgagtattactggattgattatggctctcatcattgtttctttagagttacgaaaggggataagtaatggttgtatttaaacaagtagaagttaataattttttagcaattaaagaagctacgctagagttagacaatagaggattaattctaattgaaggtgagaataaatctaatgagtcatttcattcaaacggctcaggaaaatcaactttaatatctgccattacttacgctttatatggtaaaactgaaaaaggactaaaagcagatgatgtagtaaataatattgagaagaaaaatacatctgttaaacttaagtttgatattggggaagatagttatttaattgaacgttatcgtaaagataaagagaataagaataaagtaaaattattcgttaatgaaaaagagattacaggttcaacaaatgacgttaccgataaacaaatacaagatttatttggtattgagtttaatacttacgttaatgccatcatgtatggtcaaggagatatccctatgttctctcaagcaacagataaaggtaagaaagaaattcttgaatctattactaagacagacgtatataaacaagcacaagatgtagcaaaagagaaagttaaagaagtggaagaacaacaaaataacataagacaggaaatctataaactaggttatcagttatcgacaaaagatgagtactttcaaagagaaatagagcagtacaatcaatataaagaacaattggttcagatagaaaacagtaataaggaaaaagatagattaagagaacaagaggagaagcaaatagaagctcaaatagagcaactagcttcacagataccaacaatacctgaagatgaatttaagcactcagaggagtataataaagcctctcaaagcctagatttactttctaataaattaacggagttaaatcaagtttactcagagtataataccaaagaacaagtactaaaatctgaaatagctacattaagcaatagtctaaatcagttagatacaaatgaccattgtcctgtttgtggctcccctatagataattctcataaattaaaagaacaggaaaatatcaataatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagcataattcaagaggcttctaggattaaatcagacattagttcattagagaataataaaacgtatttaaaagttaaatatcaacatcaatctgttcaaggattagagagagaagaaccaagtaaagaaaaacatgaggaagataagaaagaattacaagaatctattgacaaacatgaagagaatatagtacaattagaaactaagaaaggtaaatatcagcaagctgtagatgcttttagtaataaaggtatacgttcagtagtgttagactttattacaccattcttaaatgaaaaagcaaatgagtaccttcaaactttatcaggttcagatattgaaatagagttccaaactcaagtgaagaatgctaaaggagaactaaaagataagtttgatgttattgttaagaatagcaagggcggaggttcgtacaaatccaattcagcaggagaacaaaaacgtattgatttagcaattagttttgcaattcaggatttaattatgagtaaagatgagatatctacgaatattgcactttacgatgagtgttttgatggattagatactatcggttgtgaaaacgtgattaaattattaaaagatagacttaatacagtaggaacaatatttgtaattactcataataccgagcttaaaccactgtttgaacaaacaattaaaatcgtaaaagaaaatggagtatcaaaactggaggaaaaataatgaaattaaagattttagataaagataatgcaacacttaatgtgtttcatcgtaataaggagcacaaaacaatagataatgtaccaactgctaacttagttgattggtaccctctaagtaatgcttatgagtacaagttaagtagaaacggggaatacttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctattataacagaagaatatgatgctaatactgtagagcaaggatttagagatattggagttatattccaaagtcttaaaactattgttgttactagatacctagaaggtaaaacagaagaagaattaagaatatttaacatgaaatcagaagagtcacaactgaatgaagcacttaaagagagtgatttttctgtagatttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaaccctattacatttatgaagacttattataacattacaggtaaacaagcttttgatttattagagtctaagaatatagatatagagagagcccctttacttacgaccaataataaggatttgacagaatcagagaaacttatattaatgcttagaggtgtgcaccaagataaaggaaatactagtattaaacctcctagattacctgaagggtataaattattaaaagataacttaaataataaagagattataccctttttaaaatacttaaaaggtagaggtataactttagaacaaatcattaataacaatataggttatgttattaatgggagcttttataaagttgacggggaatccaaagtatcattaaggaatagtattatattttttacttatgataatgatggaaactaccagtactggaatacaagaagtatagagaagaacccttatattaaatctattaatgctcctgctaaacaagatgaagtagggagaaaagatgtcatatttaatttgaatatagcaagaaagaaaaagttcttagttataactgagggtgtatttgatgctttaaccttccatgagtatggagtagcaacattaggtaaacaagtaaccgagaatcaaataaaaaaaataattgattatgttagtatagatacatcaatatatattatgttagacactgatgcactagataataatatagacttagcttataagttaaaaacacattttaataaagtttactttgtacctcatggtgatgaagatgcaaatgatatggggacaaggaaagcctttgagttattaaaacagaaccgggtgttagtaacacctgaaagtatacagagttacaaaatacaacaaaaacttaaactttaggcttgaccttagagaagttttatgttatactagtaattaagtaattaataaaggagaaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgagcagatgacagacttagaatataataatgagttaaacttaaatattttaattgacgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgcagtacaaggaactgttgatggtaaacaagttgatgagaaaacagctaaacaattagatagaattggttcacgtagtgtttctttagaagaagcaactcgtattgctaaagttcttaatgctgtaacagctcaagaggttacaggagactttaatgatgcatttaatgcaattgacttaatgatgattatcatggaagatgagttaggagtaactcaagaaaaagtagggaaagctaaagataaactaaatgaaaaacgagaagcttacctaaaagagaaacaagaagaattacgtcaaaaacaacaagaagaggcacagaaaaaaactgaatctgacagcaatgaaaaagtaattcagttgaagaaaaatgacgaacagtaagaaaaaaggggatacattcgaacgtaaaatagctaaagaattaacttcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataatgttcttctaaacaacagagagccacatacatggtgggagcaagtcattaatgatagtagcaaggtgaataagacaccttgcttaatatttactagaaatagagctcagagttatgttgctttaccttatgatgaaaaagtatatgaagatttaagaaataatgaataccctgtcatgagaacagattttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagtaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggtacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaacgttcctgacactattattgatgaaatgactaagttagcttacagttttaattttaaattccctagtttcatggcagggcaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataacaactcaggacaagctaatagaggtgaactaagctcatgttatctatttgtagtagatgattcaattgagtctttaaactttgttgaagatagtgtagctaatgctagttctaatggtggtggagttgcaattgatttaactagaattagacctaaaggagctccagtacgtaatagacctaattcaagtaaaggtgttattgcttttgctaaagctattgaacataaagttagtatttatgaccagggtggtgtaagacagggtagtggtgctgtttacctaaatatattccacaatgatatcttggatttattaagctctaagaaaatcaatgccagtgagtctgttagactagataaattatctattggtgttacaatccctaacaaatttatggagttagttaaagaaggtaaacctttctatacttttgatacttacgacattaataaaatgtacggtaagtatttagatgagctaaacattgatgaatggtatgataagttactaaataatgatagtatcggtaaagtaaaacatgatgctagagaagttatgacagacattgctaaaacacaattagaatcagggtacccttatgtattctatattgataatgctaatgataatcacccattgaaaaacctaggtaaagttaaaatgagtaacttatgtacagaaatttcacaattacaagaggtatcagaaatttatccgtattcttacagtaatcagaatgttattaatagagatgttgtttgcacattaggttctcttaacttggttaatgtagttgaaaaaggtttattgaatgaatctgtagatattggtacaagagcattaacaaaagttactgatattatggatttaccttacttacctagtgttcaaaaagcaaatgatgatattagagctatcggtttaggttcaatgaatttacatggacttttagctaagaatatgattagttatggttctagagaagcattagacctagtaaacagtttatatagtgctattaacttccaatctattaagacatctatgttaatggctaaagaaacaggaaaaccatttaaaggctttgagaagtccgattacgctacaggtgaatactttgtaagatacattagagaatccaatcaacctaagacagataaagctaagaaagtcttagataaggtttatattccaacacaagatgattgggatgaattagctaaagcagtgaaagtacatggtttgtataatggttaccgaaaagcagaagcacctactcaatctatatcttatgtacagaatgctacaagttctattatgccagtacctagtgctatagagaatagacaatatggagatatggagacatattacccaatgccttacctaagtcctataactcagttcttctacgaaggagaaacagcttataagattgacaataaacgtattattaatacaagcgcagttgttcagaaacatacagaccaagcagtgtctacaatactttatgtagagtcagaaatacctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatctcccaattttggactcctgaagagtttgatgtatcaagagatttaagttcttggaatagtttaactgaaagtgaaaagaacacttataagaaagtccttgcagggctcacagggctcgatacaaagcaaggaggagaaggtatgaacttagtatcctaccacgaaccaagacctaaataccaagctgtatttgcgtttatgggtggtatggaagagatacatgctaaatcgtatagtcatatctttacaacattactaagtaataaagaaacaagttatttattagatacttgggtagaagaaaacgactttttaaaagtaaaagctcagtttatcggatattactacgaccaactattaaaacctaatcctactatatttgatagatacatggctaaagtagctagtgcctttttagaaagtgcattattctactcaggattttattatcctttacttcttgcaggaagaggtcagatgacacaatcaggagctattatttataaaattactcaagatgaagcttaccatggttcggcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagatattaaagatgaagatttctcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaggatgctaaagctgatgatacgtctaattcttttcagctagagtttatgcatgatatgaccatgtatactttatcttatggctcaggacagctaaaacttattgatttagcagaaggttatgaagcacaaaaagctacaatagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtaacacacggtaatgaagaagaaattgaaaagaatatggatgaattaatatctaagtctagaagatatatcatgagggatgaaaagcattacatgctatttaatgagaagtacaataatgataggcttatagaaaaagtatgtaaacacggtggtaaagttacatactatactgattcagtattaccttactatgttttaaaagacttatctagtcaccctgactcagaagttgtttatcgtatgcgcaacggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattaggggtagatgaaaaacaagaaaagttttatttctttgatggtgaagcttatgatttaaaacccgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttgctagaagaagggtatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaacggaaaaacacttaagaaattacttgagaagtgttctaacttaaagagagataaaacaaacagagattatgatattgattttctctacaatgcagtacctacacctattagaaatgactacggtaaaatcattaaataccaagatgttaaacaagcagaagtaaagccatactatgagagaatgaataatattattattgataattcttatgatatggtaattcctgtaggtaaactaggtgttaaatacctattaaatgttacagctattggtaaagtaagaggtgtaccaagtaaagtaactattgaaaatggaacatcttctcatgatgtgtgggtattacctacttatagcattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggggtagatattaccgcatgggacttagagactaactcattaaaacctgataaagaaggaagtaaacctttagtactatctctatcatggagaaatggtcaaggtgtaactatacccttatacaaatcagactttaactgggaaaacggtcaagatgatattgatgaagtcttagaattgcttaagaattggttagctagtaaagaagatattaaagtagcacataacggtaaatgatttgctgttgtaaaatccctctcatatcgggcatagctttaagtagctgataagagaacctaagtcctgtaataaggatagtggtaatcccgagcttacattattggtgacaatagatggggtgtagagactgagccgaggttttgtagaccaaggtgagacatagtgtatcgacttaatagaggtggtacagtgaaaaaagattatatgacatcagttaaaaataacaaaaaagtatgtagaagatgcaacgaagaattagatttatctaactttaaaacatataagaagaatgataaaacttattatcaaagtatgtgtataccttgtcggaaggaatataataagttagataaaactaaaaatactattaaaaaatgttatgagaaaaacggagataaatatagaagacaaagtaatgagtataatacttctgacagaggtagagagcttaataaaaataggtctaggaaatacagagaaaacaattctttaaaatcgaaagctagaagctctgtaagaaccgcattaagaaatggttctctcataagacctgataagtgttcagagtgtaataaagattgcatacctgaagctcaccatcctgattatactaaacctttagaaataaaatggttatgtaaatcctgtcatgaagatactcatcataaaaaataatcacactatgtaaatgagggacatcaagcccatttaggtaactacaaacaaacctaatggtaagggcttatgaaggtatagtccgttctatatagaaatatataggctaaaacgaaatatgatattaagttcttaatgagtactgaaaactttaaagattttgagagtattcaggatactaaagtaggttggtacctagctgttacccaagaagttaaagaatctttaagattatctgatttagcttatgaggttacagatgtcggaggctatgataaaccattagaagactttaaattatggtttgttactaagttattaagattcttctcagataaaattaaagagatacagaaagaaaataaaaagattgctaagaaagagtatgatgttaaagctcctgaatataaagaatggttagagaataaattaaatgaaacagtagtagaactagatgatactgagaaaaaatttagagttagtgaattagagaaaaagtatattcaactaggtctttcacctgaaattgtaaatatgaatttagttatggataatgatgaattcataaatattgcagaacaatcacctgagtacatggggttatctgactacgctaagtcttacacgttaaatactgcaattaatttaattaatgagtatagagatgtaaaagatgtagttaatgatattgacggaggtaactttaattatgattggttccctattgagttaatgcatccatacgcatcaggagatactgatgtatgtagaagaattcattgtgatgtaattaagaaacttaaagaacaagatagacctaagtcaatgcatttattagaagttaattacccaagacttactaagtctttagctagaattgaatcaaatggtttatattgtgacttagattatatgaaagaaaatgatgagtcatacgagtctgagatggctaagaaccatgctacaatgagagagcactgggctgttaaagaatttgaagaataccaatacaatctttaccaaatggcgttagaagaacatgagaaaaagccaaaagatagagataaagatatccatcagtacagagataaatttaaagatggtaaatggatgttttccccaagttccggagaccataaaggtagagtaatttatgatattctaggaattcaattaccttatgataaagaatatgtcaaggaaaaaccatttaatgctaatgttaaagaagcagaccttacttggcaggactataaaacagacaagaaagctattggttatgcgttagataatttagaattaaaagatgatgttaaagagcttcttgaattacttaaatatcatgctagtatgcagacaaaacgtaattcatttactaagaaattacttaatatgattaataaacaaaaacgaacattacatggttctttttctgagacaggcacagagacatcaagactaagtagtagtaacccttaaattggggttgtaaaactttgttaactgcgggaagagactcgttaggtcttaactactaacttataatggaaacatatataagggcaaacagtaacgtgtttgatatagtaaaaaggttaagaatagagagaatccgcatccaagaccctgaaagtatataaaagtatgggtaaggttcaacgactaggtgttgagacaatacaatcaatacacacccacgaaagcaaaggtattatttctgtggtagggaataataaggagagttatatgaaagagatttggaagaaagtagtaggatttgaaaactacgaggtaagtaataaaggaaaagtaaggaatataaaaactaactatattttaaagccgtggataataaattccggatatgagcaagtatctataggtattgctaatgtattagtacatagattagtggctatgacatttatacctaccgacagctatagtatagttaaccatattgataataataaattaaataactgtgttgaaaatttagaatgggtaagttacaaaggtaatagtgctcacgctaataagcaaggaagattgaatacttatagtgcaagagaaaaacttagttctgtatctaagaaagccatttatcaaaaagatatggaaggtaacatcattaagttatgggattcaccaagtgaagctgaaaaagaatctaatgggtactttaaaagtactaagattagttccgttgctcacggtaaacgtaagcatcatagaagttatacttgggaatacgtatataaggattcaaagagaagtttaaataagtctattaatatgtatgatttaaataataatttattatatgaagatttgacaatgaataaaattatgggtatactagaaatgaataatcataaaacattaagagataaactaagaaatacagatgactttgttgaatacagaggatataaatttaaaaataataattaaaacctaccacagaaatgatatatgatatagtctactcaatagtgagagctattgtgttacctaaacagtaacagattgtaaactaaaaagcttacaaattatagaatttacaaaacttacctgcacacacatcagatgtaaataagtttgattacaaacatccaattaaacgttcatttgtttctagatttgaaaatggagtactgctagggtccgactatagcgccctagagatgcgtattatcggattatttactaaagaccctgatatgctacaatcattcttaaatggggaagatatccataaggctactgcaagtattgtttacaataaaccagtagaagaagtaactaaagaagaacgacaagcaactaaagcagttaacttcggattagcctttggtgaatcacccttctcatttgcaggtaaaaataatatggaagtaagtgaagcagaagaaatatttgaaaagtatttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactatcatccaaggttcaggtagtttcttaacaaacatgtctttaacttacttagatgattttattcaatctcgtaatttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagccgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttatcaagaaatttaataaaagtattgacaatatagttaacttatgttatactatataagtaataaatataaggaggaaaaagagtgaatacaggggagattagatttaatcgttctatggatgaatggattataacaagcatgtaccaggatgagctaggtgggatgaatattgttgttacattctataatagagaagaaaataaacatggttctacagttttaccaacagagtcatctactggagaagtaacagaggaattggcaagtcttgaagaagaatatcctttagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggattttatgcaacaatcagctaaatatgctttttgggcttctatattagagaaggtaagagcatattctgaaatggaacaaagaaacctagaaacaattggtagtaagctaaaccttacaattagacaagagtacgaacaacaaggtaaaaagcctactaaagatatgattgaatctagtgtttatattcacgattcttatcaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcagggattcacagggttaacattacctgcagaagagggttcatctgtccttgacccatacattcaggattggataacaaatggtgttcagttcagtagattccctaataaaccaggagtacgctattacattcatgttattgaatactttaataacaatggtcaaattcaaccaaaaacggatgctcaaggaaatgtaatgattcaacctatggaattatctaatacaggatataaagaattattagctaacttaaaagacactatgttaaaaccatcacctaatgcacctcatagctttatctcagcaactgaagcattcctagttaatattgttaaagctaagaaaggtgaaatgtcatggaaagtaagtgtttatcctaatgcccctttaggtgcgttacctcaaggttgggaacaacaattatctgacttagaccaattagcaaaaccaacagaagaacaaaatcctaattttgttaacttcttaatcaataacgttaataacacagagttaagtcatgataactttaaatttaaccgtgaaacaaatgtcttaggtgaagaaccttcagagcctaaacaagcacccacacaacaagatgtagatagtcaaatgccaagtaatatgggaggacaacctaatcagcctcagcaaggtcaagtaggtcagtatgcacaacaaggtcaaagtaatggtcaaggacagcagttacaaggtacacaacaacctatcaataacactcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaacaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtcgatttaacagatttaaatacaattgatttaggtaaagaattaggattaacattgctatcagatacaaacagagcagatattaaaaacgttatacctacaatggttcctcagtatgactatattttaggtggaggtattccattaggtcggttaacagaagtttacggtttaactggcagtggtaaatctacttttgcagttcacttatctcgaattgcaacacaattaggtgttatcactatttggattgatattgaaggaacagcagataacaatcgtatggagcaacttggtgtagatgtttcaaaactattctctattcaatcaggagaaggtagacttaaaaatacagtagaattatctgtagagcaagtaggtaaagaattagagtactggattgacactttcaatgaaaagattccgggagtacctattgtatttatttgggactcattaggggctacaagaactcagaaagagattgatggcggtattgatgagaagcaaatgggtcttaaggcatcagctacccaaaaagtaattaatgcagtaacacctaaactaaatgatacaaacacagggttaattgttattaaccaagcccgtgatgatatgaatgcaggtatgtatggtgaccctattaaatctacaggtggtagagcttttgaacatagtgctagtttacgtattaaggttcataaagcatctcagttaaaacagaaaagtgagttaactggtaaagatgaataccatggtcacattatgcgtattgaaactaagaaatctaaactatcacgaccagggcaaaaagctgaagcagacttactatctgattatatggtaggtaaagaagatgaccctatcttattaaatggtatcgacttagaacatactgtatataaagaagcagttgaaagaggtttaattaccaaaggagcatggagaaactatgttacattgaatggtgaagaaattaaacttagagatgctgaatgggttcctgtacttaaagataataaagagttatatctagaattgtttagtagagtttatggagaacacttccctaatggttactcaccattacttaataacaaagtaatcgtaactcaattagaagagtatcaagctcttgaaaactactataaagaatgggctacagataataaacaagaggaacaagaggaagaactaaaaggagaatctcaagaaaaggattctgaataatagatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaagaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagggatttagatagtttacttaataggtataaaaaccttagatggtcgttatatcataggtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtctttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatacggattaccctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgcaggaacagctaatgttactgtaactactgaagatggtagtcacactgatattgttgctgtaacagttaaggaacctattcctgaagcacctgcagacgtaacagttgaacctggtgaaaatagcgcagatattactgtataggaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgattatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaatcaagattaaatcattttattaatacaacagttaaagaaattgaagatagggaaatttctaatgtaactgtttactttgttggggacttagtagaacatattaatatgagagatgttaaccaagcatttgaaacagagtttactttagcagaacaaatctctaaaggtactcgattacttattgatatcctaaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaagggctattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtgaaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatcttcaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtacaaacataatcatgtaggtataatgagttacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgctagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggggtaagagtaattaatgagcaaagacaaaccaaatagacgtaaagagatacagcatcaacctgttaactttgcccctacgaatactttaacaggagctaataatagtttctttgctaaaaagccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaagggtaaacatttgatatttatattcaaaacaagacatagagttaaagcagaaaggaaagataaataatgttaaaaggattttcagaacatgtagacaaacctacaactattaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttaagaaataaaaacagtgatataaaagttgttcctgataaagaaaaagaaagtatattatctaagttataccataataagttactacgttcaaaggtagataatgcattagatgaagatatgagttatgatgatattatagaattatgtaaagaatatgatttagaattgtctaaatcagctattacaagatataaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaaggcattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttataggggaaacaatgctctttgatgaaaataaattaaataaagttaaagattagggttgacagctcctatagtttatgatatagtatatgtatactaaaagtaaaggagctaacaattatgtttatttcattaaatcaagaagagaaagaattattaactaaagaggaaagtaaatacacaccattagaaacatcaagagagtttaacacacctaaagaagaattcattgtaacaagctataatgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtggagagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctcctcctgaagaacctgaagtagaagaagaaaaactatatactttaaatgagttaaaagagagcttactagatgctcaaggattaaaagatgttgtagctgattttcctgcatctaaagatttatatgaacctaataagttatatatctgtacaatacctaaaggatatcagtctaccgaagtacaaccaggacaatatattggtattagtactggattattatcagagtcagaagacttcagccatttaagaggtcaaatgcctagaaacttatatgaaacttctcatgttttaaaacctttgatacgtattaataatacaaatattgaataccaacaacatgagttacttgaagacattaaggatgacaaaaagatatatgatgtagagttagaagacttaagattagcaacaggagaagaagtttctcatttagaaattgttgataataagttttttgaaagtcgtattaatgaagttcttgaccgatacactgaactaacggattccaatgatttacttaagtactatagtaaattacgagaattagtaggtagtgacaaaatgatttattgttcactcctcgataaatgtgttaaaattatagattaatagtagtctcctcttatattataattgtaagaggggacatttttgtatagaggtgttaattatgtcaagaaaagcaagtatattctatatactagtggttattgttttggctttctctatctcatcttattatatatcttctttcatgtatcacgacaaagcaaaaaatgaagtctctactgagttatcgaacacaggaaagattaaagaagaaaagaacgtagaatttgtcggtgactacacattgaaaaaagtggaagataataaagcttattttatggaaacattacctacttacctaccaggtagaacaggagataacagcatagatatgaggtactacaaaacaagtagatttaaggaaggggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaactatggaaatggcagatttagaaagatttgatgcatttgtaagactaatttcagatgatgagctttcggaggaaagaatactggagttaagcgtagacttactaaacccgatactagaaggaggtacagcttacaaggctaaaaaacgtattaagagtaaatttggtaagttagaagcaaaaaattttaaacgaaactataaattcttacttaagtcgatagctcaaatagaccaaaggagataggacaatgacagaaagggaaaaattaattaaagatattgaagaggctaatagagacatacagttacagttaaaagaagtagataattataaggacagcatacgttctaaaggaacaagaaattatatttctacaaaggtattagattctattatggttggtttcatagttagttttttaatactcattataatgcgtgtacttgaatattttgtaacaggtaatgctgtttactcacctttagcgcctgcagttattattatgtttgttttagcactaggtacatggaaagtaagtaagatgaacaaaatagtatcttatagaggaactattaagatgtactgggaactaagtaatgctgagcaaaaacaagctaaggtatttaagtatcctaatgatgaagtagatattgaccagttatatagtgctgataaagtatctgttgatgcacttttagtgggtatcattaaaaattaaataaatttataaatacctgttgacagcctgttgacagcaggtattttttatagtatactttagatataaagaaaaaggaggtaatataatgatacccgtaatagttatacttattggactcatattatttttatctagcggttataagttggtattgggtaagtattatgatgatgtagatttaaaaatactatttaccatatttggtgttgggattgcattactacttggaggatttatattataaagcaggagctattttattttaaggagaggtaaatatgaattatagagattttattacagattgtattagcggtggttacaacgtacacatcagtgttacagaaaaacgagtacacattatttctgagatgacatcagcatcttaccctaaaaaggaaattaacttagatgaactacaagcttatgtgtactatatgaataattttggaagtcaaattacaacggaggggttataaatggaattggttattaatattgtagcagtattggttggtatgtatgctatttatttctatgttacaaagtttagtactggcttatcaggtattttaattgttttagggatggctattggtctttacttctacttagactatttaaatgtcagagaaaatgttattcgattagtttcagtaatgttcggagctttcttatttagtattgaaatgatttataataaaattatgttcgaaattaaaaaaagcaatgttcagaagactgttagagtgtatgataaagagcagtaatgattttaccataagagtacctaaattactttaagtgctctctatggtaccttaaagtagcttagaattgaaattaaggagatgaacaattatgtatcctgaaatagatgtggaagaattagcgtataagctaaaaagtacaagagagtatttagagagcattacaacaaaagaagtagaaatttatgaaatctatcatcttaaaacaggtaagttagtttttaaaggtgaatacattgaggtaaaagaattactgaggaaaatgtataaagaaaatttaacacttgtagatgtagatacaatgttaagcattggtaaaggatttattgatgtaattaagaatatatcggcagaaaatgtattccaaataacatataaaaaggagctatcaacaaaatgattaaaatattttcagaagtagataaagaatacaaacctattattactgaaaagtttcctaatggtgagattaattttaaatatgatgatttaaagtatttagtagaagaggacttaagatttgatgttttctttaaatgggaaaatgacgcagacttaatgcatttgtatatgtttactaagtatttagagcaactaggtattaaagataaagctgaatttttagagattgcatatctaccttatagcagaatggatagagtagaagaaggacataataatatgttcagtcttaaatacattacagaatttattaataaccttaattataaatcggtatgggtagcagaacctcatagccctgtaacagaagaattacttactaattcttttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggtgggacatttgtcggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaataaattatgctaaatccaactttaatgtgtgacttctataaactaagtcacagagaacaataccctgaaggtacagaaattgtatatagtacactagtacctagaagtaataaatattatgaacacagtgataatattgtagtatttggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacctagaaactattattagtactcaaacatggcaagcaatgactagtgctacactagcatatgatatgcgtaaaatgctagataaatatgcaatggaaacagtaggtaatattgaagcagtagatttccagggtcatgactttagtatgcgtggtatgagttctttagaaacagctcaattaagttcagcaggtcatgcaattagttttaaaggtagtgatacagtacctgtagtggatttcttagaatcatattacaatgcagacgtagagaaggaaatggttgttgcttctatccctgctactgagcactcagtaatgtgtgcaaatggtaattatgaaaccatggatgagtatgaaacatataaacgtatgttaacagaaatatatccaacaggcattttctctattgtgtctgatacttgggacttttggggtaatatgactaaaactttacctagattaaaggatattattatggaacgtaatggtaaagtagtaatcagacctgatagtggagaccctgttaaaattatttgcggagaccctgatgcagacactgaatatgaacgtaaaggtgcagtagaagtgctttgggatacatttggaggtactgaaactgaaaaagggtacaaagtattagatgaacatgtaggattaatttatggagactctattaactatgaacgtgctcaacaaatttgtgaaggattaaaagaaaaaggttttgcaagtattaatgttgtattaggtgtaggtagtttctcttaccaatttaatactcgtgatacccacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaaactttatagagaccagtcgttaagtgaaattagagaaataattaaaaataattaataaatatttaaactccctattgacaaagggagttttttattatatagtagggctatagtaaataaaggagtgaaagaaatgatttataaaatatcaaaacataattactatagtaggtttgaatattcatcttatttacctgatgaaggatttgcatatatagattatgtagatgtcattcttataggtgtagataatccaaagaagagaaaagttattactttaaaagcagatgagtttaatcctagtgattttaaggttggtcataaatataatattataaaaatactatggtttgagaaatgggaatggttacagccatagggaggagaggtatacaatgattatagataaattaaatggagttaaattagagattggcggtcatgttgtatcatttagtgtaagtaagtttaaaacgattaatggtgaaagacaattacttgattaccaccatatcaaaagaggtaaacagagatattttagaactactgaggaattctataatgagtacaaagaaataaaaccggataagaatgagatagatgaaatgtttgaatctttaggttacgtaaatactgaattagaagatgtagtaagaaaccaagagaaagtgacagagatattaggagttagtgaacagtatttaaaccaattgtcttataaggctatagaggaatatgtagaaaaaatagttatcttagaaattaaagaattaaaaggagagatacaatgataaacattaatgtaactgaaaaagaaaaattagttgtaggtgatttagtaaaatcaagagaagatggtacatggggtattgtagtagaagataagcaagacttaaatgtagttgtgttaaatgacgagccctggttattttataaatcaggaattaaaagagtagaagggcaattagaagaggactttaaatttattaaaaacagagaagagtatgatatagatgtagttaattcttcttataaataaattcacatctacctattgacttaggtagatacttattatataatagtatacaaggagatgaagtatgatgaatggaaaacaaatttatgtatttttaagtgaccaatacagtaaagatatactcagtttacaattaggtcttattaaggaatggtctaggagagaactaacttattcagatgatgtcggttcagatgcagatgttgttatttgtactgatatagtaagagatgatttcgtaaaaaaactaagtaaaaataatagcaatgcattatttgtatttattagttctagttattggataggttataaaggcggagaattctttgttgcagttcaagactatgtgaaaggtatgtaagatatgaaaaaattattaatattatttacattagctagcactttactattagcaggatgtacaccggataatcatgaaggaaaagttttaggaacaggagaatatagagagccaactacttatatcaagtcaggaagtgttactgtaccagttattggtgaaatgaaatactatgtagacttagaaacagataaaggtgaagaccgtgtttatcttaatagggaagtttatcgtaaatttgataaaggtgatgatttctctaatgtaggtaaaaaagtatataaaaatgatgaattaatatataaaggggactaattagtatgaaacaatttatacatgataaaaaagatagttataatagtacaaatcgtaattttgatattcaatattataaaggtatacctttacaacaaattgatagggggtatggtcaagcaagagctaggagatttacaataaataatacgaaccaaaatatatggatacctatgacatatttaaaacctaatggtactcttaaaaataacattgatatagattggatacttgttaaagaaaaatgtagtttaaagaaagcaggattagtaataaaaatagaaattacaggagatgtattataatgtatatattagaaagaacaattagaggttttgcaggtcaaacagaagatattttaccttaaaggagatgaattaataatggagtatgaaaaaatgattagagaaataatggtaaactctaaagaaatgtcactagaagataaaaaacatttaatgagtttattgatgagtgcttatggtgacttatcaatactagtagcttttgaagaagaaaacacagcacatatgtatgaagaaataaaacagtatgatactaaaaagttactgaaaccaagtatggtaagtaaagataattatatgaaataatatgtaaccaatcaggaggaataactaatgataaatatagaacatgattatacaataagaactgtagataatagaaagtatacttactatagtaaacatgaatccccagttactttatataaaaatattataagtaaagattgtattgaagtaactaaatatgggaaagataaaaaagttattatagctactaaatatattgtatctattgaacgatggtaattacaaggaggagtagttatgaatgctagggaagcacgtaaaaacactaaaaactataaggactctaatgtagtaactaaagagcaacacttaacttatatctataataagataaactacttgattgcaaatagtagtagtcagggtaagacatatgtggcaatgaatctaagaacagattatcctgatgagttttctttatctaaattaaaatatctaaaagaaattaaacagcactataaagacctaggatttaatgtgaaaacgcaagtaagaaaggcaaagtggtcagagaaaagtgtaatcaggtactactttaacttaggctatatagacagcgtgttagtacctattatacacattagttggtaattacaaggaggaatagttatgttttttaaaaagaagaagttaagcaatgtagagaaacaaataagacaaaaccgtaataaagaagacaaagaaagaaaagaacatcaagataagttaaatacagatatgtataaaacgtatgaattagataaaattgtagaagaacatttaagaaaattagacaatatatcccttgaaggattagaactaacttcagtgtgtttagggacaagacttgtttattattattcaataggcaaggattgggataaacaagtatatagtttaaacgaattagaatatatgaagaagaaatttaagaaactaggatttgaaactcagataacaaacgaagatataggatttcaaccttatatttatttaagattattatgggatgcataagtaattattattagaggaggaatagttggtgttgcacagttaattacggattatcatgacggacattaagtattgaatattgttgactaataataagaagaaaatattattactactaagtacctttgttatgtactactattactactactaagtacctttgttatgtactactattactactactaagtacctgggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctatgacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttttaactgatagttatgataataaagttttaaatactgtactcagatatattaatactactagtgatagagagcttagttacttaatgggtaaaggtgaagcggatgtatgtatagaaaagggagtatttagtaatatagaagatgttaaaattgactctgagtttattgatagaggtaacttatgtatacttataaatgaagatggattagtatgtagttactacagaggagaatcatgtaatgttggttcctttgtaaaggagaggttataatgatagaaattaggttaactgaagattataatgacttgagtcttaaggcattactaaaacgtattaaaagggtagctcctagggaattaacttatggtttagaagcggatatggatactacagatgttaatattggagattcagttccttctagaggtttatatgtagagtactcagaacgttttactagggacttatggataattgtacacccttcaggttatgatgcttattatcaaggagagaaatatggtggagagtctttagatgagattatacatgatatgttttatgattatgcagacccttttgacttagattattagaaaggagagattataatgatagagatataccttagtgaaaattatgataagaatttactaaaagcagaattaaaatggattaaagagaccgcttcaagagaactaacttatgatattaataggaaacctggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattatatacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcccagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaatttgagatgatttaaatggatgtaaaagaaattgcaaatactataatggagttgtggcaaatggacggctacagatgtgcagaacctccattatatgaaagcacactaaaccacacacgcacacacacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaa

SEQ ID NO: 2 - DNA, 142096 bp, Staphylococcus phage 812
ttatgtactactattactactactaagtacctttgttatgtactactattactactactaagtacctttgttatgtactactattactactactaagtacctttgttatgtactactattactactactaagtacctttgttatgtactactattactactactaagtacctgggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctatgacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttttaactgatagttatgataataaagttttaaatactgtactcagatatattaatactactagtgatagagagcttagttacttaatgggtaaaggtgaagcggatgtatgtatagaaaagggagtatttagtaatatagaagatgttaaaattgactctgagtttattgatagaggtaacttatgtatacttataaatgaagatggattagtatgtagttactacagaggagaatcatgtaatgttggttcctttgtaaaggagaggttataatgatagaaattaggttaactgaagattataatgacttgagtcttaaggcattactaaaacgtattaaaagggtagctcctagggaattaacttatggtttagaagcggatatggatactacagatgttaatattggagattcagttccttctagaggtttatatgtagagtactcagaacgttttactagggacttatggataattgtacacccttcaggttatgatgcttattatcaaggagagaaatatggtggagagtctttagatgagattatacatgatatgttttatgattatgcagacccttttgacttagattattagaaaggagagattataatgatagagatataccttagtgaaaattatgataagaatttactaaaagcagaattaaaatggattaaagagaccgcttcaagagaactaacttatgatattaataggaaacctggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattatatacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcccagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaatttgagatgatttaaatggatgtaaaagaaattgcaaatactataatggagttgtggcaaatggacggctacagatgtgcagaacctccattatatgaaagcacactaaaccacacacgcacacacacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgaatttcagggacttaggtatcggattatgggactatgacaacatcaataaactttacggatttaataaatatcgtgccaaatggtttggcggtggtgtagtattccaaagctataatatagaagatacattaaattttgcactagataatgttaaagaaatagaagcggttaagaattaaaaccgcttctgaattaaataaaaaatttatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataagttagtgtaaaattgactattgacaaggttgtattttttatggtataatgaagtgaagaccttttttagtataaaaaaattattatataaaaaatttatattaaatgattttagaaacgctctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaattcaaatggaaaaacaaaacaattaaatcaactcaaaaaacggataacattctattacttattataggtggtttagttgcaacaatcacacctaaacttgtaaactggtttttactactacaagataatataaatatttttttaagataactattgacaacctagaaacaacatgttaatattaagataacaaataaatcaataaaggaaatgataaaaatgaaaaaaatcacaacaactttaaacttaatcggcatgaaaaataatgaaaggtttacagaagagttaaaaaactaccgtcaagatgttactttcttgaaagcaaataaaattgtaaaatattcaaaataaggcttgacaacttaaacactacatgttattattaaggtacaaggtaagggaagcggtcaaccgcttccaacctaaataaaaaagtttaaaaaaactattgacagtcacttgaaaccatgatattattaagataacaaaaaacaaacagaaaaggaattgattataatgaaatttatcaaaactatcgaaaacttattaactaaagcagaaaacaaagggcaagcaattttaaacggtcgttattatgacggatatagaaacggtgagcttgaggaaaaatatgcaatcgaaattgatggcaacaaattaattatgcgtcattggggtacacaaacaattgagattgacttaagcataaatgaaattgtttcatactatggtgaaagcaattcagaccgtgacagtttaaacacacttgtatattgcttaggaattgcgccaaactttagatacttaccaagcaaagacttgttcatttacgaaaattaattaaataaagggcttgactttcaagccctaccatgttattattaaattgtaaggtaatcaagcacaacgacaaaataaactgaaaaggaattgatacaaatgaaattaatcaatagagataatgaaatcgtaattagcatagcaacacttgagagtgtaaaacaagccctaatttgggagtacatcgaccacttagataataacatcctagacaaagaaatacatgaccaggaagcggttgttattacttcagacactttgcaatcactcaaatttgcggacactatggaagaactagaagaatatgtaaacgacatcggttggaaattagtttagaaaaggtattgacatcctaacatatagatggtaatataagagtatagaaaaaataaaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcttaaccgcttctctaatacaattaatcaggagatgttgaagatgaatacaagacgggtaaacagagcgttaaacgaagcagttagattattagatgaacaaatagcagatactcaaaagactatgcaggagttgaataaacaactagagaagcaaataaaggctaagcaagagctaatggtattagttgatgttatgaatggtgatgatgagtaatgaacattagagaggttcacaatgtcgttaagagtgctaagagcaaactcctgcaggagcaggctcacccaacggataacctcatagagcagtacatcaatgatgagctacacagacgcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatgatataatgaacttaacaaattaaaagaaaaggaaatgatgaacatgacaaacttacaagaaagaaaacaagaattgaaaacgttactatttaacttagctttagagaagaacaaagcaactgatgagacactgcttagcgtattagagcaagcacatcaagaggtaggaaatcaattaagaaaagtaagaaaagaaatagaaattttagtagaagaaaaagaaagggaattttggaatgatatcgaatttaatggattagactaagagggaataaaatccctcttttatttttatcctattatataatttttttatattatacgggggcaggggtaaaatgccactcaatgggggtgggtctatatacccctatggtctacccaggtacttattttttggggaaaattatgaaaataaatatttaaaagtcaacacctaaaatatagaacgtaagtcaacaccctatattaaaagtcaacaatttatagtacaaatagagaacctctaaatataaagtcaacatatctaaaataagaaagagggaaattaaatccctcctcttaggtattattaacaacctctaattcatgtatagtaatcatatccatcccatagaaatctcttgggtctcctttaatgaactcttgctctcctctatggtttgtttcctctttataaccttcttctttaatacgtttaattaagttctccttatctgtatatatcttatcttctctaaaatggaagttatcttcataaggttcacaattatcatgttctacttggtatagtttcattagtcattttcctcctcttcgtaagaccatgtaccatattctgcattatagtgtgctgtatctgcgccttcatcttcatattctacactataccatgcatcctcctctgtttctgcatctatatatcttacctcttctgtagtaatagtacgttttactttgtatctcttcaactgtttttactcctttatattttcctctagtatttgttttaatgtctgacagtctttttggtctagagtatcccaactctctaaattttgtaattggtatagtaactcatttacaatttcatcgaaggcttctgcttttttatatacttcttctagttctgtttctgctaattttctattccttttaatttgttctgctttagctactaagatatgggctttattcatttcctctataataaagtttttatagttttccattattatttatccctcctattttctatccgttgttttatctcttctctattgcggtggtgctccttactcatttctttacgttccttatttgttaaccttatcctataaacaaggtagttaatgtataagataccggctgaccatagtagcaagaatgatattaaataagtccatgagatactaatttctatcattgtgagtcctccttatattctttatagctcttaatggctattttacaaatacctctatttacagcaacaaatactataaatgataatagtgttataactgctcttacatcccctgtaaaaggtaatgattgaaagagcaaatagttttctaaaacactaatagctgtaatagtagttagatataatatagataataagtaatcctttaattttagtttaacaaatggttttttgtgctcacctgttcttacaataccataaagtattatgaaccacataacaggtactaactgtataataaaatcattgtctacatttaatgcatgtagagcgtaaataataactgcaggaatacctataatgaatgctagaaatacataaaatataattaacattataggaagggctacaagaaaacctagaccttgttttgaatactctaatgtgtttttacctaggaacttaaaaaatgttttattcatcttcttcctccttggaattactttctgtaattgtaatttctaacatattattgtaataatcattcttttgattgatattatagttatcattgtattcattaaagtctacataaatatattcatttgcgtcattttcataaataatatctatagctgtaatatctgaatatgctgtaatcatttcataagcgttcgtattatcaggataagcaaaaccaacttgaggtatttccataggcttatcaataagaataccgaaataagtacagtgacgtgttcgacttatacttgaagtccctttatatgtaccatagtaatctataccttctgtaatacctgatatatggaacctgcttacgtctttaggctctaatcttacaacatcgcaattctctaatactaaatcaatatatttgatattcattttaactctccttttatattaataattttttccattctttatcaacctttttaagttcttttttattatagtccccgtctttagttactacagtgttccattggaacttttgtaataagctaaaattatttataatccatatattacttttactataatacatattgtcttcaaatcttatatctttttctataaaatatttatatattttatatcttctttcatctgcacctgatattttaataatttcattagtatttaattgagtggataactggaagataacatcttttactttcaataggtctttaacattacctctgcctacatggtcattatagcaatcatatttaacttttttcttttgttttctatcattaactacaatgaatatattatatacgatataagctttaaaatgggtataggtagtaggtgcttctgaatcatcacattcttttcttaggtctgtacattgtatttttaatgtaatattatttgatatgttaactacagtagagccctcatgttttttattaagatttatcttatccattttataattacctacttattgtagatacaatgtactcgaacatcttccattactttgcctaatagattctgacctttccagttactttgctctaatattttagggtcatttgctttaagacctactccccatattttatcataaggtgaagcttctacaaaatctttacgtacatctgtgtctaatattctttgctttaggtgtgtagtcataaatttatctttaactacttctaccataatattatatcttactttattccactgttcttcattaaaattacgaactttacgacctaaacttttagcatggtttgggttcttagcatttagtatttcacctgctatttgaaagtcattaaagtatcttgctttgcgccacataaaggcttgctctgagttattaaatgttcttccttggtgtttaaactttatagggtagaaattagaataaatatcctctttaccccaaaacataatatattcccttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatgattactactctctataaatgcatttaggtcagcgtatagctgaataaaaaaggacatgtcataattccaatacttaggttcatttctacctagttttttcttcattttcttatattttttattcttttttatcccaaaaacttctttttcaaagtcattcaatttaagacctttaaaatattttttcttcatttcttaacctccaatttaataaatggaaaatcaatgtttctaaatactgcgccaacatcacacattaacatgtctccattaatttctacttctccactgtctgtaggggtgtgaccacatacataggtaaaaccatcttttctaggttgaaagtctcttgaccatattaattggtcaattgtttgttcttctacaggtttccaactaaccccacctgaatgagagaatatatacttgtcttctttatagtactttctacaattaaccataagtattttaaattttctatagtcgtctgattctttaagtttctttagttcacttttaataaaatcataattatttcttagattttcctctacactactatattttaaagttactgtactcacaccgtaagagttaagtgtttctatacaatatcttgagagccattcaatatcatagatacttaatcggtctacgttttccataatattataaaactcatcatcatggttccctaacagagttactacattatcatcattagacattaaatcaaatatatagttaacaacatcttttgaccttttacctctatctacataatctcctaaaaatactattgtttcttcaggttttctttcattatttattttatccataattgttaataatttttggtattctccgtgaatatcgggaacaacgtatatagccatctaatctcctccttattgtatataactatcttaccatacttagtaaaaaaagtcaataaaaaaacacctattaaattaataggtgtttatcatttaatgttattttaaagtatcattaccatgtgctaattttttatcatctattgcatggtcattataaatatatttaacctctatatactggtcttcacttttcagtgcatctactatagaagcattattagttattgagcttgttctagggtaagtaaatttttgaccgtcagataaaataatagtaacatcaacttcaaagttaacaggtagtctgtatccataatcttccaaataattaataaagttattaagagaaaatggtttatacttgccatctaaggtatagtcaatatattcatttaatgcattagtaagttctgattctgttaactccattgtatcataatctttttcgttatagaatactacaacattaggttgttctatactagaatctccgtctttatacttagatataaaaaatccaatatttcctttatgctctaaataatctgctttcataattttaagtacttcttctgctataggttttgctaatagtgttacccattcacctttttctgcgtcataaacactaggtagtacgtttaccatcatttaaatctcctcttcttaatttattggtttaaaccacaatttactcttatcacttggttctgtttcactaactacgaaagagttagaatcaatgtttaaagtattaaaaacaatttcttgtttgtcttcattactttttgttgtaaattcgggaacatctgttaatatagactctttaccattaatagtccatgatattttaaaagacccttggctatacactgtattcggtgtcagtttttcaattataattttagcggatgcacctgtaattttttctgaagattttaataatttacctttggaatcatataagtttaatgttctctccacaaattttatctcctttactatattttgtacaattaatataacaaaaaaacacctattagtttaaataggtgtccgacagagctcccgtacttagattacggttaataatattttacgacaactatatgagaccctctgtcgttgaaactcttgtcactgcgttattccacaagatattttagaaggtagcttgtggaagaagattgtttttaaaggtacaattagcgtttttaagcctattcgatacccaggacactatgtccgtactaactattacgtcaataaaggttctacggtctcaattacctactctttattgttaaaactaaaattaagcttgagtgctctagaagccaaaatcaattaattaactatagatacggaatggaggggcactaccatccggagtctacggtcagatacaaagcctctgccgggcaacatacggtatctctcgtacatcaggttgactagacctttagagtttttcactccttctcttataaccagtaacttaagagaaataggttttacttagtagatatgaaacaataaatccacatacaatattaaatcatagtcaagtgattgcacatatgtctaacacctataagttttttgctagcctggtatatggactctgcaggattcgaacctacagtcaaaccgttatgagcggttggctttacctttaagctaagagtcctagaaatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcttattctcattataaggttaaaaaggctaactgtgtttagcattatataagaggctttagttaactactatactaataatataccataaattatacttaatgtcaagttaatttatcaattgaatctataatttttgatgtgctacgtatatctgcttctttactatgtttaaggagatattttaatttcattaaaaaagaatttttttctttttctataatatcttctttatcatcatattctgaaaacataatgaattctatacctatactatttctattatgtgaaaacatatttatagaaaaaggtgaatcaaaatttttatcatctttattaatactaaagtcttcagtaacctgtaagtcatttatttcagatatttcaaagtaaccattaactcttttaagttcaatataactattgtatctaaagtaacgttgttcttctattaacttctcttttgttatataaggatattcatttatgaatataggattacttgttccatagttatctctaatatattctgcatcctctagggaatcagtataacctaaaatttcataacttgttgtatacactgtatcttcttcccacaagtcatagtccatttcctctatttcttcttctaatatataaatttttttcatatattactcccaaaccccgataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcggatattgtcctagcattcttgttccattttcattataaaaagtatattctactacaataatattcatcatatctacatatatagcttctatatacggtgtaatattttcctcttcttgtatgtgtttacctatgatatcatataataattctgagtgtattcgtttatctctcattatagacctccgtaaggaattctacagttttgtctttcaaagatttttctactaattccatagcatctttatagtgtttgatattagattcattagacttaagtttatcttttacttcttgaattaggggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagttaattctcctttttttagtatattattaatattaccgataacagaatatgctataggcttaaaattagctctaacataagttaaaaatataaaatcatcataaaataaatctaaaacagttttattgaatctagtatttttagcttgctctaattgagcacataaattaagaacattatcaaacccactttttagaactaaagagataaatctttctactgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaagttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagcaatcctccttaataaccatgtttagttacccaccctgctaaagcatccatagctatatcatattcttcttcatttttaattcttataattttctctatttcttcctttgcttgcttagaactaataaaatcaatatcagtatcctctaggttagttaattctaagttttctctaataaaattcttttgacttggtgttatagaattaactcttacattttcgtgatttagaaattggtagaagtccatattactcatcctttttaacgtattctgccatatcttttaaaatacttagtacatactctaaatctctatattggtcatctaacgaacctataatagcatatggtgtcatatcccaggcatgtgcacagtcaaaccctaatactctcttaccctcatagtcataatcatcgtaagtgatacctctatgggcacgtctttctaaggagtcatattctttttcattgatatctgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataattagtcatctcctttttatttatatctttactatacactattttttatattttgtcaacaaaaaaaggctactaattaaagtagcctaaatattaattatttagcgttataagaccaacgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttattcctcctaattattcttacagtactaatatatcataggtctttttctaagtcatttttaaaagtttcctcgtaagaactagcgtaagtaacctcataacccactacgttagtatatcctacatataatgacttataattagattttatcttaatatcttctgattgttctagcttatttaagacttcacctaaatcatctgaagaatagtgttcattatctattgttattgttttaccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattactaatataagagaaaagcagacttattaaaagtctgcttctgtacctaattctaatcttctatttttcatatgaggaatcatttttttatctcctgttaatagagataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagttccatcttcattttctttaaatttatgagcatcataaacttctactttatcacctaatctcaaatcttgagttaagttatgtttaccaataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgggttacagttaagttatatgacccatcactaacatatcctaaatcaatatcatgtctaaaagccaaatcttctaaatgttctaataaatcgttcttttcattatgtttttcttcttctgtattatttttaattgggttaattaattctgtacaaacaatatcatacaattcaccatctgtaacctcatagttcttttcaattaatacatcttgtattttattgattgaatttgtaactactttcccatattcttcttctgtaaacttacatttatctaaatcaacatctgtaattaattctgcaatccatttatttaaaattgatactgccattgttcgagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaagtttaatcaggtttttcatagttactctaactccttaagtttattttttactttctctttatcgtacttataatctttactagagttttcatttttttctttctcttcttcattaagttctctatactgagcttcttctacctcttgttctttattatcgttatcttcttctgctttttgaatttctacattcttactactaccatttaccttttttctaaaaagaaaccaaagtattaataaaatgatgagtaaaataacaatgctcaatacaacagcccaaatattattagccattacaacctacctccgaatagtttttttacagctcttaagttttcagatgaatcgttatttatatcaattcctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcatatcctgaatttgataacttacctaagtaaaggtttatactatatccttttgtttctaatgtttgaatagcacttaacattatagcccctctgtaagcaagattttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatctgatgaattatctctacctgaaactctattcttttttaaagcagaaaagaaatcaggtagaccatcatatttaattacatttaattctgagttatctattaatcgtctacccattgattttcctcctattctaatcctaatttatccataattgtatcaaagtccattgaatcttttgatgtactatcagattttctaggttcctgcttaggctcttgttgcatacctaaaagctttcttgttgcttctgtgtatctgttaccctcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagttaactaggtcttcattgcttgataactgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgggtttcatgaaacttaccatttgcatcaataaatcctgttaatttaaattcttgagtaattgcattactgaaataaaaatctaaatctagagcttctgctacttgttctaatacatggttcttacctgaacctgctccaccttttaaaaatactggaatattttggttaactaactttagtatatcttggtatctataatggaagattcctgagatatctttaattgttttttccttcttgttgtaattcaattttaactggtaaattactaagttgttcttctacatattcttcaatttgttttttaacgtcagtaataataatttctctactctcagttcctgctttctcaacaattgcatctacaattgcttgttcatacggattagagtttttctctcctagtttgtctgccaagtcttttgttgtttccatttgttgttctaccaatctctctaatctttcaatagtatcttgctttgccatatttatcattctcctttgatttgttatacatttattatattacaagtatttgtatttgtcaacaactttctaaaactttttttagttgttaataaaaaaaaataccttacacctataacttaacatagggtaaggtaattgtcaacacttttattaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcctaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttatagtgttcaggtaaatgtgcatctacttgtatattataataatcttctaaaagacctatactttcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaaacaccctgcttggctacaagcaaggtgaaaaaggaaagatattatggaagtgtactatctaagtacacctcataatataacagttttccttgctagttattacttattttttaaggtcttcttctttgacaaacactccattaataagcttaccttttctgtcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataactttaacatttgaccttcaggtttacctgtttgtaaatttctatcttttgcccattgtttaataagttctactttttccattattctatatctcctttaatttctgtatctttgataattaggttatcagagtcacttgttacatttaaattatcttcaactaattcatgtagattattagtaatatcttcttcatacctataacctacacgaacataagctttaactctgatatctatattaacataatcttcttggaatttttccatttctaacttcctttattatatcatattatgatactattgtcaattaatctgagtagtttcctttagcaagttgatactttttgtgtaattcttcatataattctctcataccttcatagtttctcatatcatcttccaagaaactaaggtaatctaataatacttttacatcctcaggttctaaagttataactggttttaccattaggcaacctccttaaattcttctttatttattttcttgatatctttttctaatgcttcttttaattcattaggtaatttataggcatcaattgattgttgttgacctaatacataaccattatctgtaatacgtatttccactgtaaaccatgaattatctaaatcttcttctaatcttgctaataatattaaacaactattttttagaattctgttagcatacccaccaacacaatgagataacattttaccttcatctttaagtttacttacagtatctgcaggaaggaattttacttttctaccatcttttaatttataagttttatcaattattttttctaatttattatcatatttagctttaagttctgcatcatctaattgttgttgtatagattgtttctcatctgtaactatatcatgttctagttttagtgaaaatggtgttaaactaacactctctaatgttctataaccttctcttattaatattgataaatcatgtaagtaatctaagtaatagttatctagtgcatatcctgttatacgttgtctgtcttgagcatctacatctaaatagtgcgtcatctttttgtaattagcaaaagatatagataatatttgattcacaataggtttaacttttaaagcatctgtaacatctcttgaatctctaaccattaaaaaggtatcgtcaaacaattggtgtaaattaacttcattgtgtaaatgattatagtgcttatagagaatattagcaaatcttaagtaattaccttgctcaaatttatttaaagttagtaactttttataagtctgttttgtaagattgaaggcttcatgaactttccatttaggttttttaggtatatggaatagtaatgcatttctttcaaataacccaaattcttctaagttatttattttatcaatatttttaacaatatctgttaaagttattaagtaattagaagttgaattttctcctataaaaatcctatatttatctcctctataatttatatgaccataaacatctgtattatcaggacaccaactagaaaaatcaaaattatggtgctctaatgtttgttctattatctttattataattcctctagttaagttaggttgtgcatagttttttaaaataacatttaataaaacagataaagttaattcattcttatattcacttttactaatatcatctttatataggtttaaagttatttctttattaacaagactatctgttaagaaaaccttaacttctcctgttttaacgtcaaatgaacttttattttctaaaacccatttgttacccatattatgtttatctctaatatgtttaactttaagaccaaaagatgaatagttttcagtacttggatgcatgtaccaaacacggctatataattcatctgtcatagcactatagtactcactagaacctttttctatatcttcattcataacaataatagatgactttataagaccatatttaccttggtctagtacatccataatatcattatttaaactatctactacttttttatattcttctaattgtctagattcattcctccataaatggtcattaccttctagttctttaattttttcttcaacataaccttttgattgtatacgtcttctactcttataaccatatacaggaaaatcttttctttcttctctattagattcaatatactctttgtaacttcttcctttattatcatcaactacaccttcaactaatttttcaactgtttcataagggttaccttcaaagtttgttacttctttattaccacatagggctaaaaataaatgtatttctgtggctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagtccttctaaatgagtttcgtatataactttttgaattttatttaatggttctaaatctaaattcataataagttttttatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataacttcttctttcttttctatgctcatttataaacctcctggtctactctacacaaacaagtacgtattctaaattagttaaagaaactgatttaatattgtttaattcttgtaatttcttaatttccacatcatagttcttacttatagtccataatgtctctcctgctcttactttgtgataatatttatttccctctttgataaggtcattcaatattacctacccccttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctaaggttaaattaagacctacagatactatttgaaatactgaagcatcagttaataataagttgtaaaaacttatacctactgtagctacaattaaataccaaaaatagttactaactcccttgacactttctgctttaactaatgctactaaacctggtatatatcctactgtaattaatatagcatataatatacttaagtaatgtgataaattatccatcttgttcccctaatttctctaatctattaataacttcttcccatgaaataaatccttctccgtctgttagttctaaaaccataccatacacaaattggttcgtactaaattcagctctgtcagggtcattgtatggtttaccatgtccttgtctaatatccgagcagtagattaatacgggtttatttacaatgttttcaagtttatctactattaattcttcttcagtatttaatgacgtttcaaacttatttgtaaaataattaaaatactcttctccattatcatatatatggttaattgtttcttctgcttgatgtttcatacctaataaaataccgagttctgcaattgttcctaatccttcattaaggatatcaaatacaaaaatatctgattcttgcatagccttaaagtcattagttaaaatacgttctgctagcttagtttgttctgcattagctttatcatttattgacttatctttgtgagggctataaggagttactcctacaatgccatctacttctttatgttgtttatctctgtaatctaccatagcttcatttaggatatgtccacccatataaattactttgtctttaattttattacccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagatactagcaaagttttaactgtttttaaccctaaatgatgtgcaattacattcatgtcttctactgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacgcttgctaaaaatgctaatactactaaaccaggtaaatttaaaactgttgataagaataatgatattgcacttataacataaactagaccgcttagaaataaagttaataatacaattgttataagtttcaccaaccaattgttattaataaataccttagctaaataattcataaaaaaatcctccttagttattatagaataattataccataactaaggggatttgtcaacatattattttaccatttaaaattatctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagaattttttgtatgaacccttgtaagaacttttttaagttcactacgtttaaagttctgtgcttcatttataattatagtagcatctcttagatttccacctcttaggaatagatgggatatttgagatacccaacaatctcctagtttatcttctttaacattatcttccatcattaacatttcagttatttgttgttcaggattcatattaagttcaataagggcatcatgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctattactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaacactttaacagaatctacaactacactgtagttactaatagtaggatactctgtataaagtatttctacattagtattcatataactatcaattacagagttaactgtatctctttttagctcagatacattatgttttcgtatagtaggaaattcttcatcatattctactaattcttttctatctgtattcaataacttgtctaaagaggacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagatgcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaaagactaagaaattaatcttagtcttaatatattaataactattatgtgcgttgtggtatgcaagagctcctgatgttgaaccgtaacggtcaatcatatattgttttgcacctttagtttgttctgctatagaaccaccactccatgatttacctaatccttggaataatccttgagctcctgatgatgcattaacagcattagggttcattgtagattcacgcatagcaatttcaatcattgcctcgtctccacctgcttgtctaatctgttctgctacagagcctcctgtagaactagttgattgtgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccatcactaaaagagaaatcataattacctgcttgaattggttttgtatttacttctgctgaatttgatttagcttgttctgctaacttattataatcaatttcgtctgcactagcttcatttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaagagaggtaattatatttaccactctccagtttcattatatttatttattacattatctcttaattctatagcctcttctaaagattttgcactaaaatatttaactttattttttcttacaatttgtatattatatacattatttgattttttgtatatattatgtgtacttttctttcttatattagttgagttttcagacctagtagaccacttaacattaccaggttcataattaccatcattatttattctatctatttgataattttcattcggagggtctcccatatagtcgtagaattttttaaaatcattcttccattcttcacatatttctataccccttcctccatagtttttataatttatagcgttaacatcgtaacaacgctgtttcatacctaaccatctttggtacattgggttactggataatccatgggtagtattcctttctctcattaactcactatgaattttattactctcacacccacaagattttattttaccttgccttaaagtggagcttctaactattattacttctccgcattcacataaacattcatacattttacatcttgatttatccctcttactagactcttttataacttttagtttattaatagtttctccaatcataatatctcctcctataataaaactatagcataaaaaaccacctatgtcaataggtggttaaacatattatttatttaagtttgtaataacactatctgaacctatactaataggttgttttccattccatttttcaattaattgttgttgtaaaacttcctctgttaaggattcacttctaatgtcattggctttcttttcaccttttgcttcaatttctttctttttagcgttttcttctgctatttgcttatcaactttagtgcgctctagttcttggtttgcttttactctctcatcaattgctttttgagtatttttatctgcagttgggcttgataatgcaatatcatcaataataaaaccttgcttttctaaattatcattaagtttatttaaagtatcttgtttaatttctcctgtttttacaccaaaagcatcaattacagagtacttagaaattgcttgtctaacattatcttgtactctagaacgaagataccctttttcaagttcttctatgtcagcacttccgaatctattaaaaaggtttactgccttagttgcatctactttataagatacatcaatgtctaatttaatatttttaccatctgaagttgctacatttaaatctttatatttatgtgtttgtgttttagttgggtatttatttaccttatcaaaaggtgctgttaaatgccaacccggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaatagacggattttaaatccgtctaaatttatattctatttgaatactccccaggcaacgccaggtatttgattaggtggaacaccttgacaagttctaacagggcaatatactctgttaccgttgtaagcattataacctatccaaatgtgacctgcttggatacaaacttcgtcatatacaattgtagcccctgccggtaagttaccgcctactggagcatttaagaatggagaacctattctagttactataggttggttaccattgacaaatgttgcattttccggtttataccaagttccgtactggttctttttccaagaacctgtaactggtctagttgccggtgtacttgcgctacttgttttaccatctttaactactgtagaacttgaagttcctttatccatgtagtttttaatttgtttaatgaaataatcttttaatttattcattattgcttgtgatggtcttccttgtgttactggattaaatcctgtatgaagaaccatagaacggtgaggacaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatccgattattcaataaaagacgtaactcctttaccggttctcttatgaactccttatagtttcctataagactagactatatcttcaccctaattttgttaggggttctccatttcgatttaagggattctcacccactccattaacttgagccctactcctattgacgatttatttttattggcactcgtccgagggatagtcgttgaaccttaatattgtttccaaatgtatccgtaggctgtttttctctctcctttgatacatcttcctatattaccacttcttttattagaaatacctaagaactctaaagcctcttgagctgtgtaaaagacattcaataaattaccttctaagtcatactgagctatattataatttatttcattttttaatcctgtctttattgcatgttctctgttctcggaattagaaacccattctaaatttcctacactattatcatttttaccatttaaatggttaacttgttctttattatcaggattaggtataaaagccatagcaactaaacgatgtattttaggtgaatggtatcgtaaccttacaaacaagtaacccttgttatttttttgaagttttaactttttaggctctttacctttataagatattacttctcctttatcagtaatagtgtaattttcatatatttctaatccaggtatttcatttaatttcttttccataataacatctcctttacttaagtatataggaaagttattatgttgtcaagtagttttttaaaacaatattcttggatgctgattagcatagcttgatagccttagcctcccagtcaattaaaagaactttcattatacattactgtataacagggcaatttatttacccgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggcgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcatcaatggctcctgcttccattacaccaaatgatgggtcataacttgtagcttttttaactctgtaagggctatctactgttccttttgcataagcatctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagtgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctataatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattctttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctacttatactgataacctctattatctaacacatttctgtgctccaactacagttagtcgttacagcgtatctttctaggattccgctaagaccctaaaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaatttcaaaaaaattatagaagtagggacgtttacctacttctatttaatttacacaaggatgataacattgttattgttttatactggaaaacaatgtaataaaaacagtgatgtgtaaggtatttgttttattgttaattatattatagcatatactgatacctttgtcaagttaatttaatactttttttaaaacattagttatcttttgttagttcctcctgaatagcatcccatcttctttctgcttcactacgattatcttctatatgttttgtagttttacaacatttgatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaagaatactttaatatcaagggttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtatcagtacttacaggcaaaaaagtacgtatttagaaaataaggagctctcctattatagttatatatatttattactattattaattactatttaaatatataattataattaacaatgttagaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttcttagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaatgggctagtgcatctttaaactctaacttaaggatatccttatatttagtcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaataatagaaagtaattatggtataacagcagaagagataaaagttagggctaaagcacaaagaagagtagaggaagatagtaaaaaggaagattacaatgaaaacaaagaaagaaattaaagaacaaaggaaagaacttaaggatggtgctacatctgtttctttagtaaaaaagggagataagagaatagctagccctagtagaatttgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaacaagaaaaagttagaagaagaggatacaagaaaatatatagctgatgggtttatgaatggtatcggtaaattaatgtacgaatttaataagaaagtagataacaaagaaatagaagttaaagacccgaatgatttatacaaattatttgtgatattctctcaaatgcaaaatatggtcaatgaaacttctgaaggaggagcaatacctcaactatctagacctcaacaggaattatttgatgagattacaacagaagatagtaatggagaatctacagttgatttacagaagatatcagaaatgtcagcggaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaatccttctacctatatgcttaagtatcatacactgagagggcatcctataacttttagtattcctaatagagatagaagtaaagcacaggctcatagaccttggcaaactaggattgtaaatgatactcatcctaataaggctgtaataaaatcacgtcagttaggtcttagtgaaatgggtgtaatggaaatggttcattttgcagatatgcatagttatgctaatgcaaagtgtctgtatacattccctacaaacgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtactgtagagggtgtggatattgactatttatctttagatgagtatgacagggtaaacttattagcagaatcgtctgcattagaatcaatgtcttcatcaccttttaagattgtgagaagatggagcacaccttctgtacctgggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacagaatggcagttaccaatttgtttgtcaaaaatgtggtaaaccactagatagatggtataatggtgagtggcattgtaagtaccctgagcgtacaaaaggtaataaaggggtacgaggatacctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataatgttttaaaactcattaatcattttggaaaagataaagtatttggatgtacttataaatcttctcctaaatctaccggacaattaagacctgaatttaatgagaacaataatagggttacagtggataaattaatgcagaataaaagatatgtacaagcacttaagacaaaggatataagtgtttatagtacagtagatgatgatttaaaaactttcttaaaacattggcagaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatactttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagggctatttctaatggtgaagaaggaaaggtaaaccctaaaaaggtagcaaattcattatctaatttaagtaaaaaaggtgtagatgtatcacatattaatacaaactcatcattgtataaagagtttgttgatgataacggtgatacattaggaattacatcttttaaacgaactgaaaatgatataatattagaatcttatgcaagttcacatgattcagatggtgtaggagcaagagctattatggaattattacgtttaagtattaaggaaaataaaaatgcagttgtgtatgatatagaattacctgaagcagtagagtatttaaaaactttaggatttaaacctaataaagatggatacatcttaagaaaaaaagatgtaaaacaattcttaggtgattatagtgattttatttagcactatagtcatctattctattgtatttattctatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagcaaagaggagaaagaagatagtattaaagaatttagcagtttattatgtgaaatggtaaatagactatataagtcttataatgtatttagacaagaccctatggatgaaactcaacgtctagatggctctttaatggtctttcaaagtagattaaatgaccctttaacaggagatttacatgataagatgtataaacttgctttttcaaaacgtattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaacctgaacctgaacctgaacctgaacctgaaccatctgaaccgtctgacaatcctgatgaaaatggaggatgggaaactgaaccaactgaacctgagtcaccttcagagccggacgataaagtggacgaagaagataaaaatgaagatactacagatgataaacagcccactgaacaaccggacgataacaacatagataatgaagataaaactgaagaggagtaattactcctcttttttgtttgctatattaaataagagctaaatataaaaaaattgaacattacggtggtgaaaactttgttaggaatgaatattataacgtcactatcagtagtatttacttgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttactataagttttataggtgcaatacttggaggaatttggtacaagatgatgaaaattattaaaaagagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaggtaatattagtagataaagataataatatactattagaagattatgatattgttatggaaagtaagaagatgttttattacattgaagaaccgttcgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaagaacgaacataacttacatgatgttttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaagaaatgaaacgtatagaagattttattgttaatacaggtaaagataaagatgtagatagagattcatttcaaactttctgtaagaaaattgttagagatacttacatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagagttagctatgggtataagaaaccctagaactgaattatcttcttcaggatatggattatcagaagtagagatagctatgaaagagtttattgcctacaataacactgaatcatttaatgatagattcttctcccacggtggtactactagaggtattttacagatacgttcagaccaacaacaatcacaacatgcattagagaactttaagcgtgaatggaaatctagtttatcaggtatcaacggttcatggcaaataccagtggtaatggcagatgatattaaatttgtcaatatgacaccaactgctaatgatatgcaatttgagaaatggttaaattaccttatcaatattatatctgctttatatggtattgaccctgcagaaattggtttccctaatagaggaggagctacaggttctaaaggtggttctactttaaatgaggctgacccgggtaaaaaacaacaacaatctcaaaataaaggtttacaacctttacttagatttattgaagacttagttaatagacatattatatcagaatatggagataagtatacattccaattcgtaggtggagatactaagagtgctactgataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaaggcaatgaagatgaggaagttgaaaaatcagctaaagaatcaaaagaccctgtagaccaaaaagatactaagacagaaaataaagacaacgagaaacgtaaaaataaaaaagataaaaaagaagattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagtcaaaggattaactaaagaacaagaaaaagaatttgccaatgttccaggttttgaatttgaagaagaaaagaaaactactagaaaacaatcagcttctactagtaaagaagaagagcctaaggaagaggaaaagaaagcctctactagaaaaactacaaatactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacacatagatgtaagtgagatagataatttaacattagctgattatggatggtcaccggatgcagttaaagcatatatgttcggtattgtagttcaaaatcctgatacaggacagcctatgggtgacgagttctataaccatatattggaaagagcggtaggtaaagctgaaagagcattagatatatctatactacctgacactcaacatgagatgagagattatcatgagacagagtttaatagttacatgtttgtacatgcttacagaaaacctatattacaggtagagaacttacagctacagtttaatggtagacctatatataaataccctgctaactggtggaaagtagagcatctagcaggacatgttcaattattccctacagcacttatgcaaacaggacaatcaatgtcatacgatgcagtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgccccctgagttagaacagttagttataaaatatgcattgaaagaaatataccaagtatggggtaacttaattattggtgccggtattgctaataaaacattagaagtagacggtattacagagacaataggtactactcaatcagctatgtatggtggagctagtgctcagatacttcaaataaatgaagatataaaagaactattagatggtttaagagcttactttggatataatatgataggattataaggagggttagaaaatggaaaaaccgtatatgataggagctaactctaaccctaatgttattaataagtcaacaacatatactactacaacacaagcagatgaacaagataaacctaagtatactactagactagagtttgatacgattgacatgattaggtttattaatgaccgaggtataaaagtactatgggaagaagcatatttctgtccttgtcttaatcctgatacaggacatcctagagtagattgccctagatgtcatggtaaaggtattgcatatctacctcctaaagagacgataatggcaatacagtctcaagagaaaggaactaaccagttagatataggtatattagatacaggtactgcaataggtaccactcaattagaaaagagaatttcctatagagacaggtttactgttcctgaggtattgatgccccaacaaatgatttattttgtgaataaagatagaattaaaaaaggtatacctttatactacgatgtaaaagaaataacttatatagccactcaagacggtacagtctatgaagaagattatgaaatcaagaataatagattgtatttaaatgaaaaatatgagaatcatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgtcattgtactacaagacccttataaagttaatgatggtatagaagaagacctagaaattcaagtagatgaccctaaggcttcggcatctaatcctagtaatttaggtggattcttcggaggtgcatttaaataatgccagttcatggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttatctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttatcaagatatgagaactttaaaagtagataaaggaacaggttcagtttcgaagataactgattacctagaaggacgtaggaagaatgtaagccacccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagatactttagtcgaatcttctacagcaataagagaagatgataagttagtttttactgtttctaaaccaataggagagttaataaaggtagaagatatagagtttgctaaatacgataatcttcaggttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgagggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtaycggtggctcagcaggttcaagtgaaaaagtattttgcttaatcggtcaggctgaaggcggagaaccaaatacagtttatgaattacgtaactatkcacaagctaaacgtttattccgttcaggagaattacttgatgcaatagaattagcatggggttctaaccctaactatacagcaggacgtattttagctatgcgtatagaagatgctaaacctgcttcagcggaaattggcggattaaaaataacatctaaaatctacggtaatgttgctaacaacattcaagtaggattagaaaagaatacactaagtgattcattacgtttaagagtaatattccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagcaaattagataaaattgaaaatgcaaatataaaagataaagctgtatatgtaaaagcagtttttggtgacttagaaaaacaaacagcttacaatggtatcgtatctttcgagcaacttaatgcagaaggagaagtaccaagtaatgtagaggttgaagcaggagaagaatcagctacagtaactgctacttcacctattaaaactattgaaccgtttgagttaactaagttaaaaggcggtactaatggtgaaccacctgctacatgggcagacaagttagataaatttgcacatgaaggcggatactacattgttccattatcatctaaacaatcagttcatgcagaggtagcttcttttgttaaagaacgttctgatgcaggagaaccaatgagagctattgttggtggaggattcaatgaatctaaagaacaattgttcgttagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattcaaaccactacgtgtaagttcattagaccaaatctatgagtcaatagacttagatgaattaaatgaaaatggtattattagtatagagtttgttcgtaaccgtactaatacattcttcagaatcgttgacgatgtaactacattcaacgataaatcagacccagttaaggctgaaatggctgttggggaagctaatgacttcttagtaagtgagcttaaagttcaacttgaagaccggtttattggtactcgtactattaatacaagtgcttcaatcattaaagactttatccaatcttacttgggtcgtaagaaacgtgataatgaaattcaagacttccctgctgaagacgtacaagttattgttgaaggtaacgaagcaagaatttcaatgacagtttacccaatcagaatcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagacatcattgatattttagtagtagataacttaacaaaacaagttattatttcatatcatggttgtagtgctaataactacaacgagacataacttttttctgctgtgtctctgtacagtgatgtataacaaaaaaacccttctaattcatgggaacccttaacagataatgctgaaggcaatcatgagccaagcctagtaaagtactaggaaggtgcaacgactagagaaaagatagtttactgttataggcagtaaatgaaaactgagtatcgtacatctaagtagatggaaatggagggattcctaaagtaacgtttaggaatgtgatatagtctagtctatatggaaacatatagaaggtaagaagtaacgactcttatcgtaataataacaggcagaccaatgaaatcgtaactgaagaaattgagtagaagaatgctcctttaactagaaatagttatagcaaatccctttaattcatgggaacccttaacagataatgctgaaggcaatcatgagccaagcctagtaaagtactaggaaggtgcaacgactagtcagaatgacgtacatctaagcagatggaaataggggacaccttcaatattaaggtgaagatatagtctgaactatatagaaatatatagaaggttcaagagtagcgttttgaatcgtaacaaatttgtttcttatttaacagctagtgataaagcccgtacctaaagggtttaaagacctaacaataaaagttaggtcttttttattgacatataactaacgatatggtaacattaaaatataatattaaagaggtgttaagaatggataaaaaaataataggattaaatacaaaaacattagaagagaaggtttttactactataaaagaagcagaaaaagaaattgaattaagaggtaccgttaaaagatgtttaaataatgaaattaagtctactaaaggatggttatttaggtatgaaaatgaagattttcctgagaaggcaagaacaataacagacaaaagaattaaggttgttgttttaagtaaagaacaggaacaaataaagttacctcttgagatggctaaaaatttatatggaatacctaaacctatgattattgaagctattcaatataaaaggaaaattaatggctactctgttagaagagctacaaaagaagagcaaaagattacattatctaacattagttatatagactatataaaaacagttaataacccaaacaatattaaaattattaaaaataagggttcttttggtgaacagttagttaagacaatattagactataataatatagaatataaaagggaatattcttttaagaatgaattagggacaatacaaagaatggattttttagcagtagtagataataaaaaatactgtattgaatatatgggtgagcaacattatgtagagaaaggtaataagtggggctcgttagaaaagagacaatttctagattctataaagaaaaaatactgttacgaaaatgggatatactatattgatatcagttataaaaacagtgatttagagagtgtattcaatgttattaataaacacataccaggtattaaaaaaccaaataaatctattattgatattggtgtgacaataaatatagaagaaatgttagaatactataaggagcatactaaaaaagaaacagcttataaatatggagtaaaggaacataatattgataacttattagtaaatttaaactatgaaagcaaaagaaaacctaaagatataatacaagtatataagagagatgaaaaaatatttgagggcacttataatgaaattaaggatgaatttaattttactatgagtaatgttttgaaatgtttaaatggagaactagataaaacatcacaacattactttaaatataaagattcagaaaaagatagagttagacaactaaagactaaagaaagacataataaaagaggaacagtaagaggaagtagtaacaaggatgtcgttctcaaggacatatattcaggagaggaaactgtatattcttctattaaggagtgtcacgaaataacaggtctaaacaaagacaaattatacaagttatttaatccaaataaaagtaaacaaattatagacaaatatataggtaaaagctatggcggtgaataccctataactgtagaagaggctctaaatataattaacccttgaccagtatcaagggttatgttattataataaataagaagggattatattgacaaacaaaagaaaaacaataggtaaaataagtaactcaagagcaacatggaatattaatccggtaactaaagttaaaaaagataaaacaaaatattctagaaaaaataaacataaaggtcttgacaattataattaactaaggtatattattagtataacaaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaggttaaaggtaaaccaacaacaaatatacctaaattaataggttttatttttaaaaataagtttgcctacgaaaatatcatagagtacaataacacagattataatggtaatattgagaggagaattgttgttaaacatcctaaagttataactgtagaaggaaaacctagctatcagtttttgacaattagtcttgaagatgctagagttattacggtgtggtataacagtgtagatgatacacatagaacactagatttaaattattatagtaaagacttgacaattcaataaggaggtattataatgggtataacaatagtaaatagttattttattctgtctagcattttcctcatcatattaaccatattaaatggtaagggtacagttacaagggaatcattaactatgagtaaaatattagtagtaataacatcaattcaatttttagcatgtttaattattaatggtatttattggtcactaaaatttatgtagtagaactagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggcgttaatgatacttgggaaaaagaatataactttgaagaactagacttaagatttaaagttaagattaaattacctaatgcacgagaacaaggtaatatctttgcgttacgttctgcttacttaggtggtatggatatgtaccaaacagaccaagtgattagagcatatcaaatgttagctaccttacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctaccgagcaaagatttaaggacttagacgattatcagatagagtttattattgggaatatgaacagagatgtttatgaacataacaaacaacttaaacaagctcaaaaaggtggaaaattcgatagtcaattcgaagatgatgatagtagttggtggaatgaatctcatgaagactttgacccagtacctgatttcttagatgctgatgatttagcacaacaggtggaagctaaattatccgatagagataaggaagaaagagctaagagaaacgatgcggagttaaatgatgaaacagaaggacttactacacaacatctagctatgatggaatacatcagacagaaacaacaagaattagatgatgaagtaggaaatggtaagactagtgaagaggatgctactatatcacaagatagcgttaataaagcactagaagacctagatgatgactggtatatgtaaagggtggtaggtgatactaccatccttatttttttaaaatggatggtgaataatgatggcaatgaatgatgattatagattggtcttgtccggtgatagttcggatttagagaatagtctgaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgctagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgattaacatatgaccaaggtgcacgagttagaagtgagctaggtaaaataagttcttatgagagccaaagaaaacaaaaccaacgtaatttaggacaagcaagagagcaatatagcaactatagaaatcaacaacaagacttgactaaacgtagagctagcggtcaaattaataaggaacaatatgaacaagagttagcttctattaaacaggaaatgaaagctagagaagaacttatatctaactatgagaaattaggagcagaacttgataaaacagttcagtattataagggttcagttcaaaaggatttccaatctagagatgtagaccaacaacgaggaacatttggtagaatggttcaagaacgtttgccatctattggttctcatgctatgatgggtactacagctatggctacaggtttatacatgaagggtgcctcactaagtgaaactaatagacctatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggtggagtaaattctgataacatgaaggaaatgcaagatgcattcttaggtggtattaaacaatcaggcatggttggtcgtcaagatgaacaacttaaagcactaggttctatagcggaacaatcaggagaaggaagaactctaactaaagaccaaatgagtaaccttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatagctactcaaatgggtggcagtgaaaaagaacaaaaatacctatttaatagaagtatgaaagaaataggcgctaacctaactatggagcaatctgatgaaatatttaaggatgctcaatccggaaaactgtctaaagaagagttagctaagaaagctaagaaaatggaaaaagaaggtaaaaaagaaggagaagataacgccactgattataaagaatctaaatcaggaaaaaatgaccaaaataaatctaagactgatgataaagcagaagatacttatgatatggctcaaccactaagagatgctcatagtgctttagcaggtcttcctgcccctatatatttagctattggtgctataggagcatttacagcttcactaattgcatctgcaagtcaatttggagcaggtcacttaattggtaaaggagccaaaggacttagaaataaatttggtagaaataaaggcggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggctttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtattctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaacggagataaggatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggcgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggggctagaaaaacaggattagaaaattttgctaaatctaaaggtaaaaaatctagtgacatggatgttcaattagattacctatggaaagaaatgcagtctgattatgaaagcaataatcttaaaaatgcaggttggagcaaaggtggaagcttagagcagaatacaaaagcatttgctactggatttgaacgtatgggagcaaacgaggctatgatgggtactcgtgttaacaatgctaaggaattcaagaagaaatacggaggctccggtggcggaggtggtggaggagccctatcctctacttaccaagaagctatgagtaatcctgtattaactactggttctaattataggggctctaatgatgcttctaatgcttctacaactaacagaataaccgtcaatgttaatgttcaaggtggaaataatcctgaagaaactggagacattatcggaggaagaattagagaagttctagatagtaacatggatatctttgcaaatgaacataagagaagttattagtaattttgtattgacacaagagtagtatcatagtatactactcttatacatataaaaaataaaaggaagtatgtgtatatgcgtagaataagaagacctaaggtaagaatagaaatagttacagatgataatacatttacattgagatttgaagatacacgagactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccctaacgataaagaaggaaaacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattacctgaagtaggttggcttattgatggtgatggagataatgaagtaaaatttactggtagctcagctcatgaagtaatgactggtattatacgtagatttataccttatatgaaatataactatactgaaaaaacatataatacaattgataactatcttgattatgatgatttaagtagttgggatgagtttgaaaaacttacagaagtttcagcctttactaattttgatgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttctaaaccacaattccaccctgaattaactgatagatatggttatactaaatttgaagtagaaaatatttatcttagtacaaaatcaggttcagctactgaggattcagattcttcaggtgatgataatggcacagaacgaggaacttattctaaaattatgaaagatttaagtaactatggaagagataatatatctaaaggtatagataagtatacaagtaaattatcttcaaaatataaaaacttaaaaaaagcccaagctaaaaaaattatagagaagtttgttaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttattagatgaatatattaaatataaaggagagccacctaacgatgaggcttttgataaatatcttaaagctattgaaggtgttagtaatgtagctacagacacaggttcagatgcaagtgatagccctttagttatgttttctagaatgctatttaattggtatcatggtaaccctaacttctatgcaggagatattattgttttaggagaccctaagtatgacctaggtaaaagattatttattgaagataagcaacgaggagacacttgggagttctatattgaatctgtagaacataaattcgattataaacaggggtattatacaactgtaggagtaactagaggtttaaaagacgctattctagaagatggtaaaggtagtccgcatagatttgcaggattatggaatcaatcatcagacttcatgggaggtcttatgggtgaagatacttctaaagaacttaaagaaaaaggtgtagcagagaaacaaagtagtggagataaagatggtggttctgatagtggtggagctcaagatggtggctctttagattcacttaaaaaatataacggcaaacttcctaagcatgacccaagttttgttcaacctggtaaccgacattataagtatcagtgtacatggtatgcttataatagaagaggtcaattaggcatacctgtgcctttatggggggacgccgccgactggataggtggtgctaaaggagcaggttatggtgtaggtagaacacctaaacaaggtgcttgtgttatatggcaaagaggagttcaaggaggtagcccacaatatggtcacgtagcgtttgtagagaaagtattagatggaggtaaaaaaatatttatctctgaacataactatgctacccctaatggatatggtactagaacgatagatatgagttcagccataggtaagaatgcacaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccttatgttggagtaatacaaagccttaaccctcagcatgttcagtatgaatcattttctaataatggttatgatatagaggcagaattaagtttcaggaaagtaagttatttagttgataaagggtctatacctacagattctttatctactttaacagttcatttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcatatcctatgaatattaactacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcggatgatttaaatgtaaaaggattagttttagctacagttagtaaaattaattataaatatcaatcagtagaagttaaagttaacaatttaactctaggaagccgtataggtgatgatggtagcttagctgtaccttatcctaaatctttcataggaagaacacctgaaggaagcgtattcggtacaaaacctcttattactgaaggttctgtagtattaatagggtttctaaatgatgatataaatagtcctattattttaagtgtttatggtgataatgaacaaaataaaatgattaataccaatcctctagatggaggtaagtttgatacagaaagtgtttataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggagttttttatgatgatggcacgccggataatcatataactactttatttatatctgaaagaggggatataagagcctcagttttaaatacagaaacacagaaaagaactacacaggaaatgtcaagtgatgggtcttatagagttatcaaacaagatgacgatttaatgttggatgaagctcaagtttggattgagtatggtattagtgaagataataaattttatattaaaaatgacaagcataaatttgaatttactgatgagggaatctatatagatgataaacctatgttagaaaacttagatgagagtatagcagaggctatgaagaatttgaatgaaatacaaaaagaactcgatgatataaactaccttctcaagggtgtaggtaaagacaatttagaagaattaatagagtctacaaaagagtctatagaagcttctaaaaaagcaacttcagatgtcaatagacttacaactcagatagcagaagtgagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatctcagatagaggagaacatataggtgctatgatacagttagaggaaaatgtcacagtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgaccttatcttatatacaaactaactttacatctctcaatggtgagccgataccatctcttgatgatgtactaaatcattttggaacaaaagttaaatattatatagaaactaaacgtccgtttgatgctaatatggatagagaattattaactcaattaaaagcaaaaggattaataggaataggttcagagagattccaagtaattattcaatcatttgctagagaatctttaattaatattcataatcaattctctaatatacctttagcttacctaacaagtacattttctgaaagtgaaatggatgattgtttaagttatggtttttatgctattgcgcctaaatatacaactataactaaagaattagtagatttagctcatagtaaagggcttaaagtccatgcatggacggtaaacacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccctgagaactacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaacaacagaagagtttggtaacgttaaacctaatgcttctcaaagagtagatgagggtataaaagaattagataaaaatgctcgtaaaacgagagatagaaacaatcaagaaatatctagaagagaaaatacaatacctaaatctacaggagataatacgaacgagggtaatagacttaagcaaagcttccctagtagttctatatataatcctagacaatctactaacggattaaaaggtaatattgacaatatggcgctgataataggttacggtgatggaggtgtatctagctaatgaataattttataccacaacctcaaggtctacttagatttttaaataccctagatacagatttaacttcttctcatatgaatttactggatgaagaggtatcatttgtatctaaattttatacaccacagctacaattaagtgaattagcaaaaaaagtattgacaaatataaagacagatgatatacctgtattagaaagagaatttaatgataatacaattatccataaagctaacgatacattactaaaagtacaggctccaagaatgtatatgattctacagtcgattgtacttgaagcatatgctattgttaattgctttgtagaaaatccgagctctttaaaatacttaactgaagaagatgttagtataacacgggaaaatttaaattatgtagctgactacttaggtaactatgatgactataatagtgttgtcttagacttaagagatttagacttatgttttagtgctatagaattacaattacctctaatcaaaaaggaggctaacgtataatgagatttaagaagcacgtagttcaacatgaagaaacgatgcaagcaatagcacagagatactatggtgatgtgagttattggatagacctagtagagcataataatttaaagtacccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttctttaatgctacatcctaattacggttcagatttgcataatttatttggtcttaatatacctgaacaagctacattaatagaaatggaagtattgagaacattaacatcagataatagagtaaaatctgctaatctaattgattggaaaattcaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttctcgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacccgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcactgcagatacctgatgtagaaggtgtttatgtttatgaagaaacaggacatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgatgtattaatatatgatgtgtcatttgataacctagatgagaacattatagtaccgccacaaggaattattagagcaggagaaataaaagtagaactaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagtaagttacaatcttctctaaagacatctaccagtgaatatttagataagtttggggattggttcggagtttatcgtaagaccgatgagaaagatgatgtttatagagcaagaattataaaatatttactcttgaaaagaggaactaataatgctataatagatgctataaaagattatttaggtagagatgatattgatgtaagtgtatatgaaccttttacaaatattttctatactaacaaatcacatttaaatggtgaagaccacttaatgggatactattatagatttgctgttattaatgtctctataggtgattatttccctgtagagattatagatgtaattaatgaattcaaacctgcaggtgtaactctatatgtcacttatgatggggcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaaccatagcttaattaatagtttagatgttttaacaggttcatctagtgtagggagacagtatattaactacggatatgtaacatcatatgtttataatccaggtatgacatcttctgtaaatcaaataagcgctagtacagaaggtagaggtcaagaagtacctactgactattatatgtatactagtactaagaataacaatacagtagaacttagtatgcaaactacttccggtgtgtcttatttatataataactttaattttagggactatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataatttatctttctatgaaaaaaatatcgggagcaatataggatatataaaagattatctaaacagtgaattaaatatgtttactaggttagagataaatgcaggtaaaagagattcagtagatattaaagttaattacttagatttaatgttttattactatgaacgaggtatttatacaataaaaccgtataaagcattaatagaaaattatttagatatatctagagagacttatgtagaagcatttaaaatagcatcattatctaatggagatattataactaaaacaggttttcagcctatagggtatttaaaactagttggtaattatgaaaatacaatacctagcacaataaatatagtagctaaagatacagataataaccctatagaatctaatgaattagatgtatataatacagtagagaatagaaatttattacaatcttataaaggtgtaaatacgatagctagagaaataacttctacaaaagagtttactgtatcaggatgggctaaagagatatactcaactaattatctttctaaagtattaaaaccaggtaaagtgtatacgttatcttttgatatggaaataacaggtaatgacccaactcttaaatcttattctgataatcatggtatatatttatacagtaatactaagggaattgttgttaatggtgttaaatctatggaacgtactataggtaacaaagtatccgtaactcaaacttttacagcccctactattactgaccatagattactaatatatactggaagatatacatctgatggtaaagcatcaactcctccagtgttctttaatacagttaaaattacggaattaaaattgactgagggttcttctaagctagagtactcacctgctccggaagataaacctaacgtaatagaaaaaggaattaaatttaataatatcctaactaatatacagactttaagtattaattcggatactatcttaaaaaatgtaactttatattattcttactatggtgatagttgggtagaactaaagactctaggaaatattagtactggagaaacaacagaaaccaataacttaatagatttatatggattacagacagtagattattctaatataaatccaatgtctaaagtatcattacgttccatttggaatgttaagctaggtgaattgaacaatcaagaaggttctttatataatatgcctaatgattactttaatgctgtatggcaggatatagataaattatcagatattgagctaggttctatgagaatggttaaagacactgagggcggagtattcgatggagctacaggtgaaattattaaggctactctatttaatgtcggtgcttatactgatttagatatgttagcctatactttgactaattatactgaaccgttaacgttaggctctagtcgattaataattgagctaaaagaagaactactaacatcagaatcatttaatgtcgataatagaattaaagtaattgactcaatatatgaggagttaccaaatacaagcattattaaaaatggatttgttgaaagagaagttacaggttctaaatatttagattacggtttatatgagcctatagaagatggtactagatataaacttattgtcgaaggagaatttaaagataatatagaatttatatctttatacaattctaaccctaactttaatgaaacatttatatatccatcagagataattaatggagttgctgaaaaagaatttattgcaaaaccatctactgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacatatagacaagtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcaggttcatataaagtaaatggttttgaactattttcagaaggtaatgctgaagatgatgaccacgtttctgtagttgtagatgcaggtaaagcctatgtaaaaggttttaaagtagacaaacccgtatcaacaagaattagtgtacctaaatcttatgacttaggaacagcagaaaatgaaagtactatctttaataagtctaataactctattagtttagctaatagccctgtaaaagaaattagacgtgttacaggtcaagtacttattgaaaaagaacgagttacaagaggagctcaaggtgatggtcaagattttctttcaaataatacagcatttgaaattgtaaaagtttggactgaaacaagccctggagttactacaaaagagtataaacaaggagaagacttcagattaacagatggtcaaacaattgattggtcacctcaaggtcaagaaccttcaggaggtacttcatactacgtttcttataaatataacaaacgtatggaagccggtaaggattatgaagtaacaactcaaggtgaagggttaagtaagaaatggtacattaactttacaccttcaaatggtgctaaacctattgaccaaacagtagtattagtagactatacttactacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgctctagatgatggtgctatggaaggacagaaccctctaacattacgttcagtattcagtgaaggtttcattagtcttgacaaagcagacattacacatcctgacttcggaattgtatttagttttgaagatgcagaagctactctagcttatacagaagcagttaaccaacctaagattattccaggagatacaacagctcatatttggggtagattaatttcagcaccatttactgaggaacgtacaatctaccaaggtcaagcatcagaaacattaaatgttaacccttataatattcctaacaaacaaggtgtgttaaaattaacacctagtgaggataactggattgatactgaaaatgttacaatcactgaacaaaaaactaaaaagtaactatgaaacgattttggagacataatgaaagttactatggtgagactgagcattacttgtattctaacttacagttagatgcaggacaaaagtggaaaggtgaaacttacgcttatgatagagagcatggtcgtaccggtactttattggaatcaggaggacaacgtactctagaagaaatgattgaattcattagaatcagagatgtatccttcgaagttaaaggactaaaccctaatgataataatttatatttattatttgatggagtaagatgtgctataacacctgcaactggctatagaaaaggctctgaagatggtacgataatgacagatgctaaaggaacagctaaaggtaagtttactattcctgcaggtattcgttgtggtaaccgagaagttacacttaagaatgctaactctacaagtgctacaacttacacagcccaaggacgtaaaaaaacctctcaagatattattatcagaactcgtgtaacagtaaacttagtagacccgttagcacaatcattccaatatgatgagaatagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggagtacgctattgttattattactgagaacagtgattatacaatgtgggtaggtactagaactaagcctaaaattgataaacctaatgaggttatttcaggtaatccatacctacaaggtgtattattcagttcatcaaacgcatcaacatggactcctcaccaaaactctgaccttaaatttggtatttatacttctaaatttaatgagacagcaacgattgaattcgaaccaattaaagatgtatcagcggatagaatagttcttatgtctacgtacttaactcctgagagaacaggatgtacgtgggaaatgaaattaattctagatgatatggcatcttctacaacattcgaccaattgaaatgggagcctatcggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacagatatcacaacccgactttaataatattttagcatctatacctgatagtggtaactattatgtaactaattcaaaaggtgctcctagtggagaagctacagcaggatttgtaagattggataaaagaaatgtaaattattataaaatttactattcaccatatagcagtaacaaaatgtatatcaagacttatgctaatggtactgtatatgattggattagttttaaattagatgaaggtagcttatacaatgaaggtaatactttgaatgtaaaggaacttactgaatccacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctgatacgtacccttcagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacattcactatacctgaaaatacaatcggagcatcaggcgttaaagttaattacgtatctttactactaagaatgaattgttcatctagtaaaggtaatggtgctgtagtatactatgccttacctaaattagaaaaatcatctaaagttacaccatttattacacatgaaaatgatgttcgtaaatatgatgagatttggtctaattggcaagaatttattagtaaagatgaattaaaaggtcactcccctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccatatagagctaataagtttgttaaattattgtttactgacacagagggtattccttacacattatattatggtggttataaccagggttggaaacccttaaagcaatcagaaacttctactttactatggaaaggtagtttagattttgggtctacggaagctgttaacttaaatgactcattagataattacgatttaattgaggtaacttattggactcgttcagcaggacatttttctacaaaaagattagatataaaaaatacatcaaatttactgtatattagagattttaatatttcaaatgatagtacaggttctagtgtagacttttttgaagggtattgcacttttcctactagaacatcagtacaacctggtatggtaaaatctatatctttagacgggtctacaaatacaacaaaagtagcatcatggaatgaaaaggaacgtataaaggtatacaatattatgggaattaatagaggataaagaaaggtggaataaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatatttgtattatagtaaacctgaagaggttatagaaaataaaaactatgtaccaccacaaatcaatgatgatgatgaggaatcccaacaaattactgtacctaaagaacaatatgatagtttaaaagaagaactagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattacctagtaataaaaatgctgttatatcaggaactaatattttagatatagcttcaccaggtgtttactttgttatgggaatgacaggaggaatgcctagtggagtaagctccggatttttagacttaagtgtagatgctaatgataatagattagctagactaactgatgctgaaaccggtaaagaatatactagcattaagaaacctacaggaacatacacagcctggaaaaaagaatttgagccaaaagatatggagaaatatctactaagtagtattagagacgatggtagtgcatcattcccactcctagtttatactagtgatagtaaaacatttcaacaagctattatagaccatatagatagaacaggtcaaacaacctttactttctatgttcaaggcggtgtatccggttcccctatgtcgaatagttgtcgagggttattcatgtcagacacacctaatacttctagtttacatggtgtttacaatgctataggtacagatggtagaaatgtaacaggttcagtggtaggtagtaattggacttcaccaaaaacatccccttctcataaagaattatggacaggagcacaatcattcttatctacaggaactactaagaatttatcagatgatattagtaactactcttatgtagaagtttatactacacataagacaacagagaagactaaaggtaatgacaatacaggaactatatgtcataagttttatttagatggtagtggaacttacgtttgttcaggtacatttgtttccggggatagaaccgatacaaaaccccctatcacggagttttatagagtaggtgtatcttttaaaggttctacatggactcttgtagatagtgcagtacaaaatagtaaaactcaatacgttacaagaattataggtattaatatgccatagactaggagaaatttcctagtctttttttttcttgacttgaaaaggattctgtggtatactataactcgtgtaaggatataaggagattaaaatgagattaagaattaagaacttatatacctatgtagaatttgaggaggatgataaatacttaaaagatatatttttaaagagagtccatacgactataggagcaagacaagaaggatttcagtacagccctgcgtacaaaagaggtagttgggatggttatgtagatttttatgtttatgaggaagataaattccccactggacttttatttaaaattgagttattattaggtgagctacaatcaaggtataatttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaattattacctcaattagaaaaaggtgagagagtagcattcttcacaggctctacggagatattccatcagtctgcagataggctccaagagcgtttaaatattcctattggtaaagtaggtgcaggtaagtttgatgttaagcaggttacagttgtaatgatacctactttaaatgcaaaccttaaagacccaacacaaggggtaaaggttacgcctaaacaaaatattagtaaaaagattgctcaagagatattacctaaatttgaaggtggaacaaatcaaaagaaattactaaaagtattacttgataacacaacacctaaaacaaaagtagaacaaaatgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtacaataatttaatgacatgtgaaaaagctttatatcgaattgcattaacagggtctatagataaaaaagatgaattactttggatgagattgcaggcgctattcggtaatgttattgcacgaactactaataagtttttaattgatgaaggtcattctgctagaccaacaataaatattatacctgtagctaatcctaatgacatagatagaattgatgattatagggaagcttacgataaaggtataacaaataatgattttaggaataaacttattgcaaaactaacagaaaagtggtataatcaagataaaggtacattgattattgtaaacttcattgaacatggagacacaatatcagaaatgttaaatgatttagatgtagagcattacttcttacatggagaaatagactctgaaactaggagagaaaaattaaacgatatgagaagtggtaagcttaaagtaatgatagctacatcacttattgatgagggtgtagatatatcaggtattaatgcactaatattaggtgcaggaggtaagtcattaagacaaacattgcaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggggtaataataactttagttagagagtatgacacagaagaattgaaagaattcaataattctacagataatattattacttccgatttacagtatgctaaggcattaagagaaaagcacttcccttcttatagatatgagagaaaagaacaacgtagacgtactaagatagaaatggcacaatacaatgccattaaggatgagaagagaagaattatagcagatatgaatttctattcagaaggtcttccttatccttctaaagatatttttaatatgtcctatgacccggaagggttttataaagcgtacatcttatgtaagttatacgaccaatatgctatttctcatatggatgctaaacatacaagtcatcttaaagcaatgagtaaggcaacaactaaagatgaatacgactaccatcaacatatgtctgaatactatagaaataaaatgattcaaaatttacctagaaatagcgttagtgataatttctttggtagtaaaatgtttaatactttttataatttttatttaaaaataaaagataaaaatattaatgtatttaagtatatgcaaaatgtatttaaaaatgtaacattttattacgagaacggtatgcaacctaatccaataccttctcctaacttctttagctcagataagtattttaaaaactataataattatattaaaggaataaaaaaaggtgttaacagtactaatagacacctaggtgatacagacagcatcattaattcatcagactatgtgaaaaaccctgctgtattacatctacaccaactatatactacaggattaaattctactttacatgatattgatactatgtttgaacaagccttagaccttgaaaatgcctcctatggattatttggagatatgaaacatattattttactacagtataattctatgattgaagaagaaattaagaatttacctagagaagaaaaggatattattaataaatatgtaaaacaatgcataattaatgattattcaccaacaagtatttcaccttctgcaaggttatcaatgtttactatgcagaaagagcatatagtttacaataagcagttaaataaaggaatcaagagagaggatttattaccattaagtctaggaggtatagtgaataaagatttattgagtggtatggatatacaaaacttagaacagaatggtaatgaatacctatatatgagacaacatacttcaacttattatatattaagaatgtttggtgactatttagggtatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagaacaaattattgtcaatacaacaattaagaaggataaaaatattgatgttgttattattgactatcctcacttaatgagaaatccttatgctaaatatcattcagaatcagatgcaggagggaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagcggtttcttaagattgtatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatatacaacttgacattttatatgttaggtggtataattattttataaagaataaaggagagattaataatgaaatttgtattctttacagatagccactttcacttatttactaactatgctaaacctgatgagcagtatgtgaatgatagatttagagaacagatacaagctttacagaaaatgtttgatattgcaagagaagaggatgcaacagttatatttggtggggatttattccacaaacgtaacgcagtagatactagagtatataataaggtatttgaaacattccaacttaatagagatatagaagtactaatgttaagaggtaatcatgattcagttacaaatagtttatatacagattctagtatagaacctttcggttacttacctaatgtagaggtttgtaaaaaccttgatactttagggtttttaggagaagaacaggatattaatattgttatggctccttatggagacgagactgaagaaattaaagagtttattaaaaataaatatgtagaagatagagtaaatatcttagtaggtcatttaggtgtagaaggctctttgactggaaaagggtctcatagattagaaggggcatttggataccaggatttattacctgataaatatgatttcattttactaggtcattatcaccgtagacaatatttccaaaatccgaatcatttttatggtggttcattaatgcaacaatcattttctgatgagcaagaagctaatggtgttcatttaatagatacagaaaaaatgactacagaattcatcccaatccatacacgtagatttattactattcaaggagaagatattcctgagaactttgaacagctaatcgaggaagataattttattagggttatcggtacagcaaatcatgctaaggttttagaaatggatgacagtatgaaagataagaatgttgaagttcaaattaaaaaagagtatactgtagagaaacgtattgatagtgatgtgtctgatgaccctttaacaattgctagtacctatgctaaacaatactcacctgaatcagaacaagaaatacttgagtgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtagtaagtaaagacttagataaaagtaaacctattttacaattccaagattcagatggagtaatagagaatatttgtaatgttgaaggtttagaagatggtctaagtaaaatgaaaaagatttttgatgatagtaattttgaaaagcattattacaatagagtagtagaccatgatgagtattactggattgattatggctctcatcattgtttctttagagttacgaaaggggataagtaatggttgtatttaaacaagtagaagttaataattttttagcaattaaagaagctacgctagagttagacaatagaggattaattctaattgaaggtgagaataaatctaatgagtcatttcattcaaacggctcaggaaaatcaactttaatatctgccattacttacgctttatatggtaaaactgaaaaaggactaaaagcagatgatgtagtaaataatattgagaagaaaaatacatctgttaaacttaagtttgatattggggaagatagttatttaattgaacgttatcgtaaagataaagagaataagaataaagtaaaattattcgttaatgaaaaagagattacaggttcaacaaatgacgttaccgataaacaaatacaagatttatttggtattgagtttaatacttacgttaatgccatcatgtatggtcaaggagatatccctatgttctctcaagcaacagataaaggtaagaaagaaattcttgaatctattactaagacagacgtatataaacaagcacaagatgtagcaaaagagaaagttaaagaagtggaagaacaacaaaataacataagacaggaaatctataaactaggttatcagttatcgacaaaagatgagtactttcaaagagaaatagagcagtacaatcaatataaagaacaattggttcagatagaaaacagtaataaggaaaaagatagattaagagaacaagaggagaagcaaatagaagctcaaatagagcaactagcttcacagataccaacaatacctgaagatgaatttaagcactcagaggagtataataaagcctctcaaagcctagatttactttctaataaattaacggagttaaatcaagtttactcagagtataataccaaagaacaagtactaaaatctgaaatagctacattaagcaatagtctaaatcagttagatacaaatgaccattgtcctgtttgtggctcccctatagataattctcataaattaaaagaacaggaaaatatcaataatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagcataattcaagaggcttctaggattaaatcagacattagttcattagagaataataaaacgtatttaaaagttaaatatcaacatcaatctgttcaaggattagagagagaagaaccaagtaaagaaaaacatgaggaagataagaaagaattacaagaatctattgacaaacatgaagagaatatagtacaattagaaactaagaaaggtaaatatcagcaagctgtagatgcttttagtaataaaggtatacgttcagtagtgttagactttattacaccattcttaaatgaaaaagcaaatgagtaccttcaaactttatcaggttcagatattgaaatagagttccaaactcaagtgaagaatgctaaaggagaactaaaagataagtttgatgttattgttaagaatagcaagggcggaggttcgtacaaatccaattcagcaggagaacaaaaacgtattgatttagcaattagttttgcaattcaggatttaattatgagtaaagatgagatatctacgaatattgcactttacgatgagtgttttgatggattagatactatcggttgtgaaaacgtgattaaattattaaaagatagacttaatacagtaggaacaatatttgtaattactcataataccgagcttaaaccactgtttgaacaaacaattaaaatcgtaaaagaaaatggagtatcaaaactggaggaaaaataatgaaattaaagattttagataaagataatgcaacacttaatgtgtttcatcgtaataaggagcacaaaacaatagataatgtaccaactgctaacttagttgattggtaccctctaagtaatgcttatgagtacaagttaagtagaaacggggaatacttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctattataacagaagaatatgatgctaatactgtagagcaaggatttagagatattggagttatattccaaagtcttaaaactattgttgttactagatacctagaaggtaaaacagaagaagaattaagaatatttaacatgaaatcagaagagtcacaactgaatgaagcacttaaagagagtgatttttctgtagatttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaaccctattacatttatgaagacttattataacattacaggtaaacaagcttttgatttattagagtctaagaatatagatatagagagagcccctttacttacgaccaataataaggatttgacagaatcagagaaacttatattaatgcttagaggtgtgcaccaagataaaggaaatactagtattaaacctcctagattacctgaagggtataaattattaaaagataacttaaataataaagagattataccctttttaaaatacttaaaaggtagaggtataactttagaacaaatcattaataacaatataggttatgttattaatgggagcttttataaagttgacggggaatccaaagtatcattaaggaatagtattatattttttacttatgataatgatggaaactaccagtactggaatacaagaagtatagagaagaacccttatattaaatctattaatgctcctgctaaacaagatgaagtagggagaaaagatgtcatatttaatttgaatatagcaagaaagaaaaagttcttagttataactgagggtgtatttgatgctttaaccttccatgagtatggagtagcaacattaggtaaacaagtaaccgagaatcaaataaaaaaaataattgattatgttagtatagatacatcaatatatattatgttagacactgatgcactagataataatatagacttagcttataagttaaaaacacattttaataaagtttactttgtacctcatggtgatgaagatgcaaatgatatggggacaaggaaagcctttgagttattaaaacagaaccgggtgttagtaacacctgaaagtatacagagttacaaaatacaacaaaaacttaaactttaggcttgaccttagagaagttttatgttatactagtaattaagtaattaataaaggagaaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgagcagatgacagacttagaatataataatgagttaaacttaaatattttaattgacgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgyagtacaaggaactgttgatggtaaacaagttgatgagaaaacagctaaacaattakatagaattggttcacgtagtgtttctttagaagaagcaactcgtattgctaaagttcttaatgctgtaacagctcaagaggttacaggagactttaatgatgcatttaatgcaattgacttaatgatgattatcatggaagatgagttaggagtaactcaagaaaaagtagggaaagctaaagataaactaaatgaaaaacgagaagcttacctaaaagagaaacaagaagaattacgtcaaaaacaacaagaagaggcacagaaaaaaactgaatctgacagcaatgaaaaagtaattcagttgaagaaaaatgacgaacagtaagaaaaaaggggatacattcgaacgtaaaatagctaaagaattaacttcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataatgttcttctaaacaacagagagccacatacatggtgggagcaagtcattaatgatagtagcaaggtgaataagacaccttgcttaatatttactagaaatagagctcagagttatgttgctttaccttatgatgaaaaagtatatgaagatttaagaaataatgaataccctgtcatgagaacagattttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagtaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggtacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaasgttcctgacactattattgatgaaatgactaagttagcttacagttttaattttaaattccctagtttcatggcagggcaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataacaactcaggacaagctaatagaggtgaactaagctcatgttatctatttgtagtagatgattcaattgagtctttaaactttgttgaagatagtgtagctaatgctagttctaatggtggtggagttgcaattgatttaactagaattagacctaaaggagctccagtacgtaatagacctaattcaagtaaaggtgttattgcttttgctaaagctattgaacataaagttagtatttatgaccagggtggtgtaagacagggtagtggtgctgtttacctaaatatattccacaatgatatcttggatttattaagctctaagaaaatcaatgccagtgagtctgttagactagataaattatctattggtgttacaatccctaacaaatttatggagttagttaaagaaggtaaacctttctatacttttgatacttacgacattaataaartgtacggtaagtatttagatgagctaaacattgatgaatggtatgataagttactarataatgatagtatcggtaaagtaaaacatgatgctagagaagttatgacagayattgctaaaacacaattagaatcaggctacccttatgtattctatattgataatgctaatgataatcacccattgaaaaacctaggtaaagttaaaatgagtaacttatgtacagaaatttcacaattacaagaggtatcagaaatttatccgtattcttacagtaatcagaatgttattaatagagatgttgtttgcacattaggttctcttaacttggttaatgtagttgaaaaaggtttattgaatgaatctgtagatattggtacaagagcattaacaaaagttactgatattatggatttaccttacttacctagtgttcaaaaagcaaatgatgatattagagctatcggtttaggttcaatgaatttacatggacttttagctaagaatatgattagttatggttctagagaagcattagacctagtaaacagtttatatagtgctattaacttccaatctattaagacatctatgttaatggctaaagaaacaggaaaaccatttaaaggctttgagaagtccgattacgctacaggtgaatactttgtaagatacattagagaatccaatcaacctaagacagataaagctaagaaagtcttagataaggtttatattccaacacaagatgattgggatgaattagctaaagcagtgaaagtacatggtttgtataatggttaccgaaaagcagaagcacctactcaatctatatcttatgtacagaatgctacaagttctattatgccagtacctagtgctatagagaatagacaatatggagatatggagacatattacccaatgccttacctaagtcctataactcagttcttctacgaaggagaaacagcttataagattgacaataaacgtattattaatacaagcgcagttgttcagaaacatacagaccaagcagtgtctacaatactttatgtagagtcagaaatacctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatctcccaattttggactcctgaagagtttgatgtatcaagagatttaagttcttggaatagtttaactgaaagtgaaaagaacacttataagaaagtccttgcagggctcacagggctcgatacaaagcaaggaggagaaggtatgaacttagtatcctaccacgaaccaagacctaaataccaagctgtatttgcgtttatgggtggtatggaagagatacatgctaaatcgtatagtcatatctttacaacattactaagtaataaagaaacaagttatttattagatacttgggtagaagaaaacgactttttaaaagtaaaagctcagtttatcggatattactacgaccaactattaaaacctaatcctactatatttgatagatacatggctaaagtagctagtgcctttttagaaagtgcattattctactcaggattttattatcctttacttcttgcaggaagaggtcagatgacacaatcaggagctattatttataaaattactcaagatgaagcttaccatggttcggcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagatattaaagatgaagatttctcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaagatgctaaagctgatgatacgtctaaktcttttcagctagagtttatgcatgatatgaccatgtatactttatcttatggctcaggacagctaaaacttattgatttagcagaaggttatgaagcacaaaaagctacartagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtaacacacggtaatgaagaagaaattgaaaagaatatggatgaattaatatctaagtctagaagatatatcatgagggatgaaaagcattacatgctatttaatgagaagtacaataatgataggcttatagaaaaagtatgtaaacacggtggtaaagttacatactatactgattcagtattaccttactatgttttaaaagacttatctagtcaccctgactcagaagttgtttatcgtatgcgcaacggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattaggggtagatgaaaaacaagaaaagttttatttctttgatggtgaagcttatgatttaaaacccgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttgctagaagaagggtatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaacggaaaaacacttaagaaattacttgagaagtgttctaacttaaagagagataaaacaaacagagattatgatattgattttctctacaatgcagtacctacacctattagaaatgactacggtaaaatcattaaataccaagatgttaaacaagcagaagtaaagccatactatgagagaatgaataatattattattgataattcttatgatatggtaattcctgtaggtaaactaggtgttaaatacctattaaatgttacagctattggtaaagtaagaggtgtaccaagtaaagtaactattgaaaatggaacatcttctcatgatgtgtgggtattacctacttatagcattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggggtagatattaccgcatgggacttagagactaactcattaaaacctgataaagaaggaagtaaacctttagtactatctctatcatggagaaatggtcaaggtgtaactatacccttatacaaatcagactttaactgggaaaacggtcaagatgatattgatgaagtcttagaattgcttaagaattggttagctagtaaagaagatattaaagtagcacataacggtaaatgatttgctgttgtaaaatccctctcatatcgggcatagctttaagtagctgataagagaacctaagtcctgtaataaggatagtggtaatcccgagcttacattattggtgacaatagatggggtgtagagactgagccgaggttttgtagaccaaggtgagacatagtgtatcgacttaatagaggtggtacagtgaaaaaagattatatgacatcagttaaaaataacaaaaaagtatgtagaagatgcaacgaagaattagatttatctaactttaaaacatataagaagaatgataaaacttattatcaaagtatgtgtataccttgtcggaaggaatataataagttagataaaactaaaaatactattaaaaaatgttatgagaaaaacggagataaatatagaagacaaagtaatgagtataatacttctgacagaggtagagagcttaataaaaataggtctaggaaatacagagaaaacaattctttaaaatcgaaagctagaagctctgtaagaaccgcattaagaaatggttctctcataagacctgataagtgttcagagtgtaataaagattgcatacctgaagctcaccatcctgattatactaaacctttagaaataaaatggttatgtaaatcctgtcatgaagatactcatcataaaaaataatcacactatgtaaatgagggacatcaagcccatttaggtaactacaaacaaacctaatggtaagggcttatgaaggtatagtccgttctatatagaaatatataggctaaaacgaaatatgatattaagttcttaatgagtactgaaaactttaaagattttgagagtattcaggatactaaagtaggttggtacctagctgttacccaagaagttaaagaatctttaagattatctgatttagcttatgaggttacagatgtcggaggctatgataaaccattagaagactttaaattatggtttgttactaagttattaagattcttctcagataaaattaaagagatacagaaagaaaataaaaagattgctaagaaagagtatgatgttaaagctcctgaatataaagaatggttagagaataaattaaatgaaacagtagtagaactagatgatactgagaaaaaatttagagttagtgaattagagaaaaagtatattcaactaggtctttcacctgaaattgtaaatatgaatttagttatggataatgatgaattcataaatattgcagaacaatcacctgagtacatggggttatctgactacgctaagtcttacacgttaaatactgcaattaatttaattaatgagtatagagatgtaaaagatgtagttaatgatattgacggaggtaactttaattatgattggttccctattgagttaatgcatccatacgcatcaggagatactgatgtatgtagaagaattcattgtgatgtaattaagaaacttaaagaacaagatagacctaagtcaatgcatttattagaagttaattacccaagacttactaagtctttagctagaattgaatcaaatggtttatattgtgacttagattatatgaaagaaaatgatgagtcatacgagtctgagatggctaagaaccatgctacaatgagagagcactgggctgttaaagaatttgaagaataccaatacaatctttaccaaatggcgttagaagaacatgagaaaaagccaaaagatagagataaagatatccatcagtacagagataaatttaaagatggtaaatggatgttttccccaagttccggagaccataaaggtagagtaatttatgatattctaggaattcaattaccttatgataaagaatatgtcaaggaaaaaccatttaatgctaatgttaaagaagcagaccttacttggcaggactataaaacagacaagaaagctattggttatgcgttagataatttagaattaaaagatgatgttaaagagcttcttgaattacttaaatatcatgctagtatgcagacaaaacgtaattcatttactaagaaattacttaatatgattaataaacaaaaacgaacattacatggttctttttctgagacaggcacagagacatcaagactaagtagtagtaacccttaaattggggttgtaaaactttgttaactgcgggaagagactcgttaggtcttaactactaacttataatggaaacatatataagggcaaacagtaacgtgtttgatatagtaaaaaggttaagaatagagagaatccgcatccaagaccctgaaagtatataaaagtatgggtaaggttcaacgactaggtgttgagacaatacaatcaatacacacccacgaaagcaaaggtattatttctgtggtagggaataataaggagagttatatgaaagagatttggaagaaagtagtaggatttgaaaactacgaggtaagtaataaaggaaaagtaaggaatataaaaactaactatattttaaagccgtggataataaattccggatatgagcaagtatctataggtattgctaatgtattagtacatagattagtggctatgacatttatacctaccgacagctatagtatagttaaccatattgataataataaattaaataactgtgttgaaaatttagaatgggtaagttacaaaggtaatagtgctcacgctaataagcaaggaagattgaatacttatagtgcaagagaaaaacttagttctgtatctaagaaagccatttatcaaaaagatatggaaggtaacatcattaagttatgggattcaccaagtgaagctgaaaaagaatctaatgggtactttaaaagtactaagattagttccgttgctcacggtaaacgtaagcatcatagaagttatacttgggaatacgtatataaggattcaaagagaagtttaaataagtctattaatatgtatgatttaaataataatttattatatgaagatttgacaatgaataaaattatgggtatactagaaatgaataatcataaaacattaagagataaactaagaaatacagatgactttgttgaatacagaggatataaatttaaaaataataattaaaacctaccacagaaatgatatatgatatagtctactcaatagtgagagctattgtgttacctaaacagtaacagattgtaaactaaaaagcttacaaattatagaatttacaaaacttacctgcacacacatcagatgtaaataagtttgattacaaacatccaattaaacgttcatttgtttctagatttgaaaatggagtactgctagggtccgactatagcgccctagagatgcgtattatcggattatttactaaagaccctgatatgctacaatcattcttaaatggggaagatatccataaggctactgcaagtattgtttacaataaaccagtagaagaagtaactaaagaagaacgacaagcaactaaagcagttaacttcggattagcctttggtgaatcacccttctcatttgcaggtaaaaataatatggaagtaagtgaagcagaagaaatatttgaaaagtatttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactatcatccaaggttcaggtagtttcttaacaaacatgtctttaacttacttagatgattttattcaatctcgtaatttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagccgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttatcaagaaatttaataaaagtattgacaatatagttaacttatgttatactatataagtaataaatataaggaggaaaaagagtgaatacaggggagattagatttaatcgttctatggatgaatggattataacaagcatgtaccaggatgagctaggtgggatgaatattgttgttacattctataatagagaagaaaataaacatggttctacagttttaccaacagagtcatctactggagaagtaacagaggaattggcaagtcttgaagaagaatatcctttagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggattttatgcaacaatcagctaaatatgctttttgggcttctatattagagaaggtaagagcatattctgaaatggaacaaagaaacctagaaacaattggtagtaagctaaaccttacaattagacaagagtacgaacaacaaggtaaaaagcctactaaagatatgattgaatctagtgtttatattcacgattcttatcaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcagggattcacagggttaacattacctgcagaagagggttcatctgtccttgacccatacattcaggattggataacaaatggtgttcagttcagtagattccctaataaaccaggagtacgctattacattcatgttattgaatactttaataacaatggtcaaattcaaccaaaaacggatgctcaaggaaatgtaatgattcaacctatggaattatctaatacaggatataaagaattattagctaacttaaaagacactatgttaaaaccatcacctaatgcacctcatagctttatctcagcaactgaagcattcctagttaatattgttaaagctaagaaaggtgaaatgtcatggaaagtaagtgtttatcctaatgcccctttaggtgcgttacctcaaggttgggaacaacaattatctgacttagaccaattagcaaaaccaacagaagaacaaaatcctaattttgttaacttcttaatcaataacgttaataacacagagttaagtcatgataactttaaatttaaccgtgaaacaaatgtcttaggtgaagaaccttcagagcctaaacaagcacccacacaacaagatgtagatagtcaaatgccaagtaatatgggaggacaacctaatcagcctcagcaaggtcaagtaggtcagtatgcacaacaaggtcaaagtaatggtcaaggacagcagttacaaggtacacaacaacctatcaataacactcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaacaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtcgatttaacagatttaaatacaattgatttaggtaaagaattaggattaacattgctatcagatacaaacagagcagatattaaaaacgttatacctacaatggttcctcagtatgactatattttaggtggaggtattccattaggtcggttaacagaagtttacggtttaactggcagtggtaaatctacttttgcagttcacttatctcgaattgcaacacaattaggtgttatcactatttggattgatattgaaggaacagcagataacaatcgtatggagcaacttggtgtagatgtttcaaaactattctctattcaatcaggagaaggtagacttaaaaatacagtagaattatctgtagagcaagtaggtaaagaattagagtactggattgacactttcaatgaaaagattccgggagtacctattgtatttatttgggactcattaggggctacaagaactcagaaagagattgatggcggtattgatgagaagcaaatgggtcttaaggcatcagctacccaaaaagtaattaatgcagtaacacctaaactaaatgatacaaacacagggttaattgttattaaccaagcccgtgatgatatgaatgcaggtatgtatggtgaccctattaaatctacaggtggtagagcttttgaacatagtgctagtttacgtattaaggttcataaagcatctcagttaaaacagaaaagtgagttaactggtaaagatgaataccatggtcacattatgcgtattgaaactaagaaatctaaactatcacgaccagggcaaaaagctgaagcagacttactatctgattatatggtaggtaaagaagatgaccctatcttattaaatggtatcgacttagaacatactgtatataaagaagcagttgaaagaggtttaattaccaaaggagcatggagaaactatgttacattgaatggtgaagaaattaaacttagagatgctgaatgggttcctgtacttaaagataataaagagttatatctagaattgtttagtagagtttatggagaacacttccctaatggttactcaccattacttaataacaaagtaatcgtaactcaattagaagagtatcaagctcttgaaaactactataaagaatgggctacagataataaacaagaggaacaagaggaagaactaaaaggagaatctcaagaaaaggattctgaataatagatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaagaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagggatttagatagtttacttaataggtataaaaaccttagatggtcgttatatcataggtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtctttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatacggattamcctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgcaggaacagctaatgttactgtaactactgaagatggtagtcacactgatattgttgctgtaacagttaaggaacctattcctgaagcacctgcagacgtaacagttgaacctggtgaaaatagcgcagatattactgtataggaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgattatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaatcaagattaaatcattttattaatacaacagttaaagaaattgaagatagggaaatttctaatgtaactgtttactttgttggggacttagtagaacatattaatatgagagatgttaaccaagcatttgaaacagagtttactttagcagaacaaatctctaaaggtactcgattacttattgatatcctaaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaagggctattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtgaaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatcttcaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtacaaacataatcatgtaggtataatgagttacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgctagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggggtaagagtaattaatgagcaaagacaaaccaaatagacgtaaagagatacagcatcaacctgttaactttgcccctacgaatactttaacaggagctaataatagtttctttgctaaaaagccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaagggtaaacatttgatatttatattcaaaacaagacatagagttaaagcagaaaggaaagataaataatgttaaaaggattttcagaacatgtagacaaacctacaactattaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttaagaaataaaaacagtgatataaaagttgttcctgataaagaaaaagaaagtatattatctaagttataccataataagttactacgttcaaaggtagataatgcattagatgaagatatgagttatgatgatattatagaattatgtaaagaatatgatttagaattgtctaaatcagctattacaagatataaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaaggcattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttataggggaaacaatgctctttgatgaaaataaattaaataaagttaaagattagggttgacagctcctatagtttatgatatagtatatgtatactaaaagtaaaggagctaacaattatgtttatttcattaaatcaagaagagaaagaattattaactaaagaggaaagtaaatacacaccattagaaacatcaagagagtttaacacacctaaagaagaattcattgtaacaagctataatgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtggagagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctcctcctgaagaacctgaagtagaagaagaaaaactatatactttaaatgagttaaaagagagcttactagatgctcaaggattaaaagatgttgtagctgattttcctgcatctaaagatttatatgaacctaataagttatatatctgtacaatacctaaaggatatcagtctaccgaagtacaaccaggacaatatattggtattagtactggattattatcagagtcagaagacttcagccatttaagaggtcaaatgcctagaaacttatatgaaacttctcatgttttaaaacctttgatacgtattaataatacaaatattgaataccaacaacatgagttacttgaagacattaaggatgacaaaaagatatatgatgtagagttagaagacttaagattagcaacaggagaagaagtttctcatttagaaattgttgataataagttttttgaaagtcgtattaatgaagttcttgaccgatacactgaactaacggattccaatgatttacttaagtactatagtaaattacgagaattagtaggtagtgacaaaatgatttattgttcactcctcgataaatgtgttaaaattatagattaatagtagtctcctcttatattataattgtaagaggggacatttttgtatagaggtgttaattatgtcaagaaaagcaagtatattctatatactagtggttattgttttggctttctctatctcatcttattatatatcttctttcatgtatcacgacaaagcaaaaaatgaagtctctactgagttatcgaacacaggaaagattaaagaagaaaagaacgtagaatttgtcggtgactacacattgaaaaaagtggaagataataaagcttattttatggaaacattacctacttacctaccaggtagaacaggagataacagcatagatatgaggtactacaaaacaagtagatttaaggaaggggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaactatggaaatggcagatttagaaagatttgatgcatttgtaagactaatttcagatgatgagctttcggaggaaagaatactggagttaagcgtagacttactaaacccgatactagaaggaggtacagcttacaaggctaaaaaacgtattaagagtaaatttggtaagttagaagcaaaaaattttaaacgaaactataaattcttacttaagtcgatagctcaaatagaccaaaggagataggacaatgacagaaagggaaaaattaattaaagatattgaagaggctaatagagacatacagttacagttaaaagaagtagataattataaggacagcatacgttctaaaggaacaagaaattatatttctacaaaggtattagattctattatggttggtttcatagttagttttttaatactcattataatgcgtgtacttgaatattttgtaacaggtaatgctgtttactcacctttagcgcctgcagttattattatgtttgttttagcactaggtacatggaaagtaagtaagatgaacaaaatagtatcttatagaggaactattaagatgtactgggaactaagtaatgctgagcaaaaacaagctaaggtatttaagtatcctaatgatgaagtagatattgtatcaaaacataacttaagacaaataacttttagtgagattaatatacttcatcttaaatatatgagatataataaggcagtagaacaacatactaaattatctaaagaactttttaaaaaagataaagaaactgttgacaagaacaaataagtgtagtatagtattactaaaggaggagagatattatggttatacctagtattaaagcacaaaacaaattcaagaatgagttagagtattataaacaaggtcacattagtgaaagtaaaatgttagaattagcttttgattacatccaagaattagaacaaaataacgaatacgttactaacttgctagaagaggagagatatggtgagtaaatttatcggagtgtacttatttaatttactaatagctattattttaactttaaccttaataggtactattactgactcaattgagagtactttagcccaaataatcgtagggatgttcataatcattactatatatggaatcctatcagcgttaatacctattctagttcataaagctgtatcaccgggatggagctatactgaatggaatgaatcctattacatcagattacctggagaagagaactacaagtactatagtaaatggtatttagatttattaggagttaaagaattttactataagagagacaatggagaagaagtaaaagaaaaaaatatatcatgggcttttcaagctgaagtaaaaagacctgaagatgttaaccactggaaaaaccaattgcttactaatagacctttaacaattttagaatataaaaaattaaagaaattagataaggaaagtgaaattaggaaacaagaagatttagaagaatataaacaatacaatagtaattaaagaggtggaaagcaatgataagctcatttgatagtatactacttgtcatatacattattatagcttttgcagtagctatggcaattatctacttagtatttaaaggtatgactattctactagataagctaatgatgttattattaagtaaaactacattagatgtagaagcttgctctatgataatggcagtcatcagtacaattgtgtttggaattattgtacttttaatatggctagcagtaaataatattttactataaggagatttactatggattttaatgactttataaacagtgaatcggatagggtaggtaagcctaaacaaaagaagaaggtagagaataagctaccttcttctactcctattgaagataaggaaaagaaattaaaagagataagaaagaaatcattatatattgatttaaggagaaaaagaaatgactaaagaaacaaatgtactttacaaagataagtatagagattatactatagttgtaagattagcagggaatattattgttactgaagtagataagaaacataaaacagcatttacacctattatatttgacaatggtgtagaaggcgtagagcttgtaatgcgtataggttctgtagagcttaacatgacagatttacgtgagttcacaaaagaagtatctacggctcagaaagctttagaatattttaataaaaaactttacattaaaggcttgacagatgaagcattttaatatatactaaaagtataaataaaataaagaaaagaggaatgattattatgttattaggaattttatggtttatatggggatttgtatcatactttgtattgatgtttggaattgagttttggaaagatagatggatgccaggtgttatcggagcaggagccttactactattcttattttggattatgaaatctatccataatgctatgacagtagtatacttgtattaggaggttgtatagatggatatactaattattcattataaagaaacaaataaacgggttttaaaagaaacaatacaaacaatacaaaatcatttaaatgatgaacatggtttggttaagatgacagcaacaaaacttagcagagagaatatagagaaaagatttaataactataatatagtcattgcagaagatgaccctgataattcttatcattacggtgaagctgtagaagacgcagattttattatagacataccaatttcatatttagatatacatgcaggaatagaatgggatgttgataatcctgtagatatgctagataggaatcctgattttatagaagctgtaaataaactaaatgaagacttaatgttataaggaggaaatagaatgctaaatgaaaaactaaaaaacctggaagatacaaaagtatacatgattaatagtattgcaagtttactaagcgcaagtacaggaaaatcaagtaaagtattttttgatgaagggactattaaaattgtaagtggtgaaacaaaagcagtagaagtcattgataacttagttcaccctcactcaggacgtttacctattaaaacaacagaacgtattgcgctaggtagattaacagattctttacagtttgttatttcagaaatagaagtagttaaagaccaaattatagatgaagaaaatgaagcttacattgattttgtgatggaagactggaactgggattaatgcctatggacttattaactattgcttctgttgcttttatagctgtagtcattattgatttgattaatgatgatatgagctatatgcttactggtactgcaatcttaataaatatttgggcaggattttatggatggtttttcttactgcaagcaggaatgttacttttcttactattagctaggaaagttaaagatgataaggagtcaatactatattccagtgcttcattaatatgtgcactaggaatgataataaatcttctttcattttcttaaaaataagtattgacacctttgtacttttgtattatacttagtatataacaagtacaggagatgattactatgagtaaagaaacaattagaagacaattttcaaatgcaattgagattatggcaacaactaaagaatggtggaacttccctaaaagttttgatacgaataaagaatttaaaattaaaacttttaaaaatgatacacttgtatttgaagtcagagaaggcagtagaaatttaggaagctttgtagtttttacaaacattgattttgattatgataaactagaaggaacttcaacacaatatatgattaattactttgctaagaaattaactaaagatatgtttaactatcataaattacaattatagtaggaggtggaaagatgagagaagagttaaaaccttttaataggaaacaagttaatgttaagggttacttagatgatgttaagtattcaaagcgtagaagacataaaggtaatcaacatgggtgtgttaaaatcacagttactgatgtaaagattaatggtatacctattgaccacgttaacattgaagttagtatctctttctatgaaaaactaaaggagcttcaaggaaagagaattcaatttgtaggtactgtttataagtatgttaaacatgctagggggcgcaaaggtagaattaaaggattttataaagaggattatagcgtaactttagataagaagttacaaaaggaggaaaaataatgattaaaagaagaaaacatttagaccactcattacagcctgagaaaggatggagaacagtaccttttaatgggtattatgaagcgcatcctacgggtttaattagaaataaagtaacgaaaaagttaattaaaggtacacagacaagaaagaaccatcctaagtggactgctcatgagattgtatacctaattaaccctaagaaaacaagttattctaggggagtagttattgcacatacattccctgaaatgattagtcaatcacgaggagaccttaagaacggtcatgtgtgttttaaagatggtgaccgaagtaattgtcatgtagacaatatgtttattggtaaaggtaatgttaacaaaaatatctataaattaaatgattcttatttaactagaaaagatattgaagaggatgttaataatttagttaatgaaagattattctctcaattagaattattgattaagaaaaatgaaccggaaagaattacacctagtaatcactttattaaaagagataataatgtgttcagtatcacagatttatctaaaaactcactagtagagtttgagttagaaatcaagaatattaagtaaggtggttatataaatgaatgagtggtatgctttatgttattataacaaaataggtaaaaagaaaatacctagacaaattaaagctcacagggatgtatctgtattagaggatttaaaagatagattagaagaacaaaatcctaaagaagaatacaagattaaaacaacaaaagaatttgataaggaaagataattaatgttaacacctcaacaaaaggattcattaaaagagcaacaaaaaaaattaagtaaaaagaagaaataagtcttgacaattgagtatacataggttatacttaagttaacaaataaagaggaggtatgacctatgttattcgtaatttttatattggcagtactgtttgtacttggatttatgaatggatggaactcagaagactagataaggagtggttgtaatgaagttagaagataaagtgttagagagaattgattctcttggaaataaagcaggtaacttaagtaatcaagtaatggagtcattagtaaagtatcaaattacgtacggtattatagatattgttgtaagtattttagttattgcactaacaatatttttaggtaaggtttaccttaaagaatataagaaggttaaaatggatttaaaagaaagcttattgtatgatgattacgatgacttaagtggtatcggatggtgttacacaattctattaatactattaacgttattctctctttacgcaatagttgcaggtatcccaactgatattatgagattaattaatccggaagtttatgcagtaaaagatttaattgagcaagttaaaggaggaaattaaaatgaaacaaagagactttgaatttgaagaggattttgtattaacttatgagtgtgaggattgtaagcatttcgaagactggggtcatgatgaagagcctgaagaatgtagtgaatgtggaagtagtgatttaatcaataatacaagtcatgaagatactgagtgtgatatgtgtcgagggtatattgatatgtggcaagatggatatagatatatgggagataataaagagtatattgaaaaagaggaatcaggtttgatttgtgaagattgttatgagaaattagatatttaataaggaggaaattaatatgaataaagcagtagaacaagcaagtaatgcattaggtcaaggattttcagctatggtatggcatcaagtattagtagggttagggtttattttattaggattggtattatctttactggtttgggtattagtaaaaaaattccatgtaccttttaatcacccgacagcttttgtagtgtactcaattatgttagtgagtattgttgctagttttatttggggcggtttacatgtaattaaccctgagtattatgctattttagaacttaaaggttttataaagtaggaggaattctatgactaaagaagagttagagcaaaaagtaaaagaacttgaagcagagaataaagagcttaaaaaacaaatagaacgttttgaagacgaaggaggaaaaacaaaagatgaacagtagagaaaagaaaattttaacactaacagtaaataattttttaatgttagctttagatattgtagcacttgttaggtacaagaaaggtaaaattaagcaagagaattataacacaggtcaaatttcaagaactatagttacaacagccaactcattaggtattctttacctagaagagcaagaacgtaaagaaaaaaaatctgttaaaataggtactcttgaaagtggtactctaagagggtttaaaaataaataaaaaagtttaagaaacctattgacattaggtttcttttattatatactaagagtataagaaataaggaggttaatttatgaatggtattattgtattttacaaagaagaaaataaacatattctaaagaagctcttagaattcattaacacaacatcaaaaggattaacttacaccttagagggtacattagttgataatgatatcgttttacttaaagataacaacatatgtgattataacctaagacagtttagtaagacaaatgatggcttagttataggtctattgagtgaatcatataatgatgttcattactatgaaaaaggagatgcctacggtatagaaagattaactatgtatttagaggagatgagtcaataatggtaattgcattttttattttaggtctattattagtattatgtttagttggtcttgctattattaaagtactagaagcaaggctaaagaaaaaagaactaaggagagaaagagaatcttttggtattcctgaaccagggagaaaattagggcacataggatatgtcgaaagtaaatatgctttaattcataaagaatcaagtaagataataataagcgcagagaaaagtaaagttgtagaaacattacagaaaatgtataatttagagttaacatctgtagatgtttctagtgtaacgggactctctcccttaggtacaggacgtatggagaatatggtattgctttcatacaaactagaaagagaatgactttataaattaattgaacttaataaggagtgatacaatggaatttatagataaaaataatgtaattaaagcttatgatataccgaatgtttacttaaaaggttacgtattgtatgcatgtgataaaaatggagacattacaacctatgatgggtatgaccaaatacactataaagatggtagagtattaacattcccttttgataagccgttaagaaagataaatgtactttcaggatattacaaactatttaagaaggaggacatactatgatttattttgttagtgatttacattttggtcatgataatattagagaatttgaagcacctacaagaagtcattggaattcagtagaagaaatgactgaaggtttgattgaactatggaataacacaattacaaataatgatattgtttataatatcggagacttcttctttaatatgaaaccatctaaagtagaagaaatacttaatagactaaattacaaagagatgacattgattgcaggtaatcatgaccataaaaagcttgttaagctatatgaacgtaatggtatcacagtgaagtatgctgatatgcttaagaaggaaggtaaaagattttatctgagtcactaccctacacttattggaagaaagaatatgtttaatattcatggtcatatacattcacaactaatggatactgattaccacattaatgtaggttatgatgtagaaggaaagattgcatatagttttgatgatattctaagtatagcaggtgagtatagtggagaaattcaaaggtaaagacttatataagactagaattagaaaacaaacaattaaaaatttaattattaaagtagagaaattacataataaacatagcccttatcaacctattggtcatgtttattattaccctaaaacaaaagagtttactttatctaaacccgagcaaaagatatttatagagtatatgaaagaattaggttttaatgtaaaacacaagagacgtaagaaaacacttattatttataagaatgcattcactgaatacattagtaggtatcatgaagcaatagagcagattgaaggagggaaataatggaatatttatttttatttataggtattggcatgataatttggggtttcatagcaccttatcttgcatttgtagtttactataaacatgtaagagaaaatcataatggattcagtgatgaggaatctctagaagaggctatagtatttggtatgggattcatgtttatagcatttattcctataggtatactagttgtaattgaagaaattaagattttattcttttaaatgttgacagctacaatatagtgtgttacagtatagaaaaggaggttaattaatgaagcattttattttaattttaggaattgtaatactagttattgcattaggtattgttttaccggcatggattttacagttagtactatctgcattcggagttaaagtaagtatttgggtatgtatcggaatatttattttaatcagtgcaataggaagtatgtttagcagaaattaaaggaggaactataaatggcaaaatatgaatcaaatattaatggagagaattatattgcaacaccgtcacaagctttaagagaggcactagcaaaattaataactgaagaaaagagctttgcggagtaccaaactaaaggtgaggagcagtatgaatcacagttacaactaagacactttgatacaatgatatctcagtatgaggaagctattagagtactagaagataaatatagacctcagatttttattccgaaagataataaggaggaaaattaattatgaaagcagaatcaatagcaagattttttaatgacaaagtactacaaatagagggttataaagtaagattcttacaggctagttcatcgtatattttagatatagatactatagatgaatcagtattgtttttagaagctcaagtatctacactttcaggtaaacatttattagatacagctattacaattgagagacctgaaacattaagtgctaaagagctatatacagaaattagtaataaactacaagctattgtaggagaccaaactaaaacaactatagaactatcaagatattttaaggaggaaaaataagtgtctaataaaaccattacaaattatttattaaatttagaaggaataaaaggagaaacgtatagtattattgctcatatcaataaacaaactggttggggtgataaaggggattattttgaaataagcataagttataaagctgataaagaccctagaacaacgagatatattacaactgaaatttttgttgattatggtagtaataatccaaaagaaattttattacaattaagagataagattttttctattgtagaagaacaggtagagactgacaatgattttattgaatctattaaagaaattaattcaactaaagaattagaaaaactaaagccttatatcaataatgaatattattcaatgtttaaatcttctattgaaaaggaaatacctgtagctttatcttctgaagtactcaatagatgtacaggtaaaacaagcacattagcttatttagcactagaaaaggatttacccttagtagtatcaaatgaacctatgagaaaaatgcttaaaaataaattccctcatcttagagtagcttctgctgaagattattcaaattatgatattaaaggtgaaattgttctaatagatgaagtagatattgaccagttatatagtgctgataaagtatctgttgatgcacttttagtgggtatcattaaaaattaaataaatttataaatacctgttgacagcctgttgacagcaggtattttttatagtatactttagatataaagaaaaaggaggtaatataatgatacccgtaatagttatacttattggactcatattatttttatctagcggttataagttggtattgggtaagtattatgatgatgtagatttaaaaatactatttaccatatttggtgttgggattgcattactacttggaggatttatattataaagcaggagctattttattttaaggagaggtaaatatgaattatagagattttattacagattgtattagcggtggttacaacgtacacatcagtgttacagaaaaacgagtacacattatttctgagatgacatcagcatcttaccctaaaaaggaaattaacttagatgaactacaagcttatgtgtactatatgaataattttggaagtcaaattacaacggaggggttataaatggaattggttattaatattgtagcagtattggttggtatgtatgctatttatttctatgttacaaagtttagtactggcttatcaggtattttaattgttttagggatggctattggtctttacttctacttagactatttaaatgtcagagaaaatgttattcgattagtttcagtaatgttcggagctttcttatttagtattgaaatgatttataataaaattatgttcgaaattaaaaaaagcaatgttcagaagactgttagagtgtatgataaagagcagtaatgattttaccataagagtacctaaattactttaagtgctctctatggtaccttaaagtagcttagaattgaaattaaggagatgaacaattatgtatcctgaaatagatgtggaagaattagcgtataagctaaaaagtacaagagagtatttagagagcattacaacaaaagaagtagaaatttatgaaatctatcatcttaaaacaggtaagttagtttttaaaggtgaatacattgaggtaaaagaattactgaggaaaatgtataaagaaaatttaacacttgtagatgtagatacaatgttaagcattggtaaaggatttattgatgtaattaagaatatatcggcagaaaatgtattccaaataacatataaaaaggagctatcaacaaaatgattaaaatattttcagaagtagataaagaatacaaacctattattactgaaaagtttcctaatggtgagattaattttaaatatgatgatttaaagtatttagtagaagaggacttaagatttgatgttttctttaaatgggaaaatgacgcagacttaatgcatttgtatatgtttactaagtatttagagcaactaggtattaaagataaagctgaatttttagagattgcatatctaccttatagcagaatggatagagtagaagaaggacataataatatgttcagtcttaaatacattacagaatttattaataaccttaattataaatcggtatgggtagcagaacctcatagccctgtaacagaagaattacttactaattcttttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggtgggacatttgtcggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaataaattatgctaaatccaactttaatgtgtgacttctataaactaagtcacagagaacaataccctgaaggtacagaaattgtatatagtacactagtacctagaagtaataaatattatgaacacagtgataatattgtagtatttggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacctagaaactattattagtactcaaacatggcaagcaatgactagtgctacactagcatatgatatgcgtaaaatgctagataaatatgcaatggaaacagtaggtaatattgaagcagtagatttccagggtcatgactttagtatgcgtggtatgagttctttagaaacagctcaattaagttcagcaggtcatgcaattagttttaaaggtagtgatacagtacctgtagtggatttcttagaatcatattacaatgcagacgtagagaaggaaatggttgttgcttctatccctgctactgagcactcagtaatgtgtgcaaatggtaattatgaaaccatggatgagtatgaaacatataaacgtatgttaacagaaatatatccaacaggcattttctctattgtgtctgatacttgggacttttggggtaatatgactaaaactttacctagattaaaggatattattatggaacgtaatggtaaagtagtaatcagacctgatagtggagaccctgttaaaattatttgcggagaccctgatgcagacactgaatatgaacgtaaaggtgcagtagaagtgctttgggatacatttggaggtactgaaactgaaaaagggtacaaagtattagatgaacatgtaggattaatttatggagactctattaactatgaacgtgctcaacaaatttgtgaaggattaaaagaaaaaggttttgcaagtattaatgttgtattaggtgtaggtagtttctcttaccaatttaatactcgtgatacccacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaaactttatagagaccagtcgttaagtgaaattagagaaataattaaaaataattaataaatatttaaactccctattgacaaagggagttttttattatatagtagggctatagtaaataaaggagtgaaagaaatgatttataaaatatcaaaacataattactatagtaggtttgaatattcatcttatttacctgatgaaggatttgcatatatagattatgtagatgtcattcttataggtgtagataatccaaagaagagaaaagttattactttaaaagcagatgagtttaatcctagtgattttaaggttggtcataaatataatattataaaaatactatggtttgagaaatgggaatggttacagccatagggaggagaggtatacaatgattatagataaattaaatggagttaaattagagattggcggtcatgttgtatcatttagtgtaagtaagtttaaaacgattaatggtgaaagacaattacttgattaccaccatatcaaaagaggtaaacagagatattttagaactactgaggaattctataatgagtacaaagaaataaaaccggataagaatgagatagatgaaatgtttgaatctttaggttacgtaaatactgaattagaagatgtagtaagaaaccaagagaaagtgacagagatattaggagttagtgaacagtatttaaaccaattgtcttataaggctatagaggaatatgtagaaaaaatagttatcttagaaattaaagaattaaaaggagagatacaatgataaacattaatgtaactgaaaaagaaaaattagttgtaggtgatttagtaaaatcaagagaagatggtacatggggtattgtagtagaagataagcaagacttaaatgtagttgtgttaaatgacgagccctggttattttataaatcaggaattaaaagagtagaagggcaattagaagaggactttaaatttattaaaaacagagaagagtatgatatagatgtagttaattcttcttataaataaattcacatctacctattgacttaggtagatacttattatataatagtatacaaggagatgaagtatgatgaatggaaaacaaatttatgtatttttaagtgaccaatacagtaaagatatactcagtttacaattaggtcttattaaggaatggtctaggagagaactaacttattcagatgatgtcggttcagatgcagatgttgttatttgtactgatatagtaagagatgatttcgtaaaaaaactaagtaaaaataatagcaatgcattatttgtatttattagttctagttattggataggttataaaggcggagaattctttgttgcagttcaagactatgtgaaaggtatgtaagatatgaaaaaattattaatattatttacattagctagcactttactattagcaggatgtacaccggataatcatgaaggaaaagttttaggaacaggagaatatagagagccaactacttatatcaagtcaggaagtgttactgtaccagttattggtgaaatgaaatactatgtagacttagaaacagataaaggtgaagaccgtgtttatcttaatagggaagtttatcgtaaatttgataaaggtgatgatttctctaatgtaggtaaaaaagtatataaaaatgatgaattaatatataaaggggactaattagtatgaaacaatttatacatgataaaaaagatagttataatagtacaaatcgtaattttgatattcaatattataaaggtatacctttacaacaaattgatagggggtatggtcaagcaagagctaggagatttacaataaataatacgaaccaaaatatatggatacctatgacatatttaaaacctaatggtactcttaaaaataacattgatatagattggatacttgttaaagaaaaatgtagtttaaagaaagcaggattagtaataaaaatagaaattacaggagatgtattataatgtatatattagaaagaacaattagaggttttgcaggtcaaacagaagatattttaccttaaaggagatgaattaataatggagtatgaaaaaatgattagagaaataatggtaaactctaaagaaatgtcactagaagataaaaaacatttaatgagtttattgatgagtgcttatggtgacttatcaatactagtagcttttgaagaagaaaacacagcacatatgtatgaagaaataaaacagtatgatactaaaaagttactgaaaccaagtatggtaagtaaagataattatatgaaataatatgtaaccaatcaggaggaataactaatgataaatatagaacatgattatacaataagaactgtagataatagaaagtatacttactatagtaaacatgaatccccagttactttatataaaaatattataagtaaagattgtattgaagtaactaaatatgggaaagataaaaaagttattatagctactaaatatattgtatctattgaacgatggtaattacaaggaggagtagttatgaatgctagggaagcacgtaaaaacactaaaaactataaggactctaatgtagtaactaaagagcaacacttaacttatatctataataagataaactacttgattgcaaatagtagtagtcagggtaagacatatgtggcaatgaatctaagaacagattatcctgatgagttttctttatctaaattaaaatatctaaaagaaattaaacagcactataaagacctaggatttaatgtgaaaacgcaagtaagaaaggcaaagtggtcagagaaaagtgtaatcaggtactactttaacttaggctatatagacagcgtgttagtacctattatacacattagttggtaattacaaggaggaatagttatgttttttaaaaagaagaagttaagcaatgtagagaaacaaataagacaaaaccgtaataaagaagacaaagaaagaaaagaacatcaagataagttaaatacagatatgtataaaacgtatgaattagataaaattgtagaagaacatttaagaaaattagacaatatatcccttgaaggattagaactaacttcagtgtgtttagggacaagacttgtttattattattcaataggcaaggattgggataaacaagtatatagtttaaacgaattagaatatatgaagaagaaatttaagaaactaggatttgaaactcagataacaaacgaagatataggatttcaaccttatatttatttaagattattatgggatgcataagtaattattattagaggaggaatagttggtgttgcacagttaattacggattatcatgacggacattaagtattgaatattgttgactaataataagaagaaaatattattactactaagtacctttgttatgtactactattactactactaagtacctttgttatgtactactattactactactaagtacctttgttatgtactactattactactactaagtacctttgttatgtacttgtactactattactactactaagtacctttg

SEQ ID NO: 3 - DNA, 419 bp, Artificial Sequence
  Description of Artificial Sequence: Synthetic polynucleotide
ttggcgggtgtcggggctggcttaagggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacct

SEQ ID NO: 4 - DNA, 1370 bp, Artificial Sequence
  Description of Artificial Sequence: Synthetic polynucleotide
ggtttacttagaaagtagtattgttggtgacgaactacctcttggaacgtacagacaggtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaaggaggatgattatttatggtattcacattagaggatttcgtgggagattggcgacagacggcaggttataacttagaccaggttttagagcaaggtggtgtatcttctttgtttcagaacttgggagtcagtgttacacctattcagcgtatagtcttgagtggtgagaacggattaaagattgatatccatgtcattattccttacgaaggattgtcaggagatcaaatgggacagatcgaaaagattttcaaggtagtgtacccagtcgatgaccaccacttcaaggtaatattgcactatggtacattggtaatcgacggagtaacacctaacatgatagactatttcggaagaccttacgagggtatcgcggtcttcgatggtaagaagattactgtcacgggaactttgtggaacggcaacaaaatcatagacgagagattaataaaccctgacggaagtttgttgtttcgagtgacaataaacggagtgactggttggagattgtgcgaacgtatattagcttaataaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggtgatgcaatattcaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcagggggatgtgctgcaaggcgattaa

SEQ ID NO: 5 - DNA, 1749 bp, Artificial Sequence
  Description of Artificial Sequence: Synthetic polynucleotide
ttggcgggtgtcggggctggcttaagggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacgtacagacaggtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaaggaggatgattatttatggtattcacattagaggatttcgtgggagattggcgacagacggcaggttataacttagaccaggttttagagcaaggtggtgtatcttctttgtttcagaacttgggagtcagtgttacacctattcagcgtatagtcttgagtggtgagaacggattaaagattgatatccatgtcattattccttacgaaggattgtcaggagatcaaatgggacagatcgaaaagattttcaaggtagtgtacccagtcgatgaccaccacttcaaggtaatattgcactatggtacattggtaatcgacggagtaacacctaacatgatagactatttcggaagaccttacgagggtatcgcggtcttcgatggtaagaagattactgtcacgggaactttgtggaacggcaacaaaatcatagacgagagattaataaaccctgacggaagtttgttgtttcgagtgacaataaacggagtgactggttggagattgtgcgaacgtatattagcttaataaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggtgatgcaatattcaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcagggggatgtgctgcaaggcgattaa

SEQ ID NO: 6 - DNA, 143 bp, Artificial Sequence
  Description of Artificial Sequence: Synthetic polynucleotide
aacaattccaaaatagaagtgagcagacaactgctaaagaaagatttattgtagaagtttaaaggaggatgattatttatggtattcacattagaggatttcgtgggagattggcgacagacggcaggttataacttagacca

SEQ ID NO: 7 - DNA, 143 bp, Artificial Sequence
  Description of Artificial Sequence: Synthetic polynucleotide
gtgacaataaacggagtgactggttggagattgtgcgaacgtatattagcttaataaagaaagggagataattctaaatggcaattaattttaaaggttcaccttatttagatagatttgacccgtctaaagatagaacaaaa

SEQ ID NO: 8 - DNA, 146 bp, Artificial Sequence
  Description of Artificial Sequence: Synthetic polynucleotide
gataataaacaattccaaaatagaagtgagcagacaactgctaaagaaagatttattgtagaagtttaaaggaggatgattatttatggtattcacattagaggatttcgtgggagattggcgacagacggcaggttataacttag

SEQ ID NO: 9 - DNA, 146 bp, Artificial Sequence
  Description of Artificial Sequence: Synthetic polynucleotide
tgttgtttcgagtgacaataaacggagtgactggttggagattgtgcgaacgtatattagcttaataaagaaagggagataattctaaatggcaattaattttaaaggttcaccttatttagatagatttgacccgtctaaagata

SEQ ID NO: 10 - DNA, 25 bp, Artificial Sequence
  Description of Artificial Sequence: Synthetic primer
ttaatcgccttgcagcacatccccc

SEQ ID NO: 11 - DNA, 25 bp, Artificial Sequence
  Description of Artificial Sequence: Synthetic primer
ttggcgggtgtcggggctggcttaa

SEQ ID NO: 12 - DNA, 33 bp, Artificial Sequence
  Description of Artificial Sequence: Synthetic primer
ctatctctaaagtaagaagagtagaattaagga

SEQ ID NO: 13 - DNA, 30 bp, Artificial Sequence
  Description of Artificial Sequence: Synthetic primer
actttaaaaccttttacataggctttacct

SEQ ID NO: 14 - DNA, 127929 bp, Artificial Sequence
  Description of Artificial Sequence: Synthetic polynucleotide
ggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcttaaccgcttctctaatacaattaatcaggagatgttgaagatgaatacaagacgggtaaacagagcgttaaacgaagcagttagattattagatgaacaaatagcagatactcaaaagactatgcaggagttgaataaacaactagagaagcaaataaaggctaagcaagagctaatggtattagttgatgttatgaatggtgatgatgagtaatgaacattagagaggttcacaatgtcgttaagagtgctaagagcaaactcctgcaggagcaggctcacccaacggataacctcatagagcagtacatcaatgatgagctacacagacgcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatgatataatgaacttaacaaattaaaagaaaaggaaatgatgaacatgacaaacttacaagaaagaaaacaagaattgaaaacgttactatttaacttagctttagagaagaacaaagcaactgatgagacactgcttagcgtattagagcaagcacatcaagaggtaggaaatcaattaagaaaagtaagaaaagaaatagaaattttagtagaagaaaaagaaagggaattttggaatgatatcgaatttaatggattagactaagagggaataaaatccctcttttatttttatcctattatataatttttttatattatacgggggcaggggtaaaatgccactcaatgggggtgggtctatatacccctatggtctacccaggtacttattttttggggaaaattatgaaaataaatatttaaaagtcaacacctaaaatatagaacgtaagtcaacaccctatattaaaagtcaacaatttatagtacaaatagagaacctctaaatataaagtcaacatatctaaaataagaaagagggaaattaaatccctcctcttaggtattattaacaacctctaattcatgtatagtaatcatatccatcccatagaaatctcttgggtctcctttaatgaactcttgctctcctctatggtttgtttcctctttataaccttcttctttaatacgtttaattaagttctccttatctgtatatatcttatcttctctaaaatggaagttatcttcataaggttcacaattatcatgttctacttggtatagtttcattagtcattttcctcctcttcgtaagaccatgtaccatattctgcattatagtgtgctgtatctgcgccttcatcttcatattctacactataccatgcatcctcctctgtttctgcatctatatatcttacctcttctgtagtaatagtacgttttactttgtatctcttcaactgtttttactcctttatattttcctctagtatttgttttaatgtctgacagtctttttggtctagagtatcccaactctctaaattttgtaattggtatagtaactcatttacaatttcatcgaaggcttctgcttttttatatacttcttctagttctgtttctgctaattttctattccttttaatttgttctgctttagctactaagatatgggctttattcatttcctctataataaagtttttatagttttccattattatttatccctcctattttctatccgttgttttatctcttctctattgcggtggtgctccttactcatttctttacgttccttatttgttaaccttatcctataaacaaggtagttaatgtataagataccggctgaccatagtagcaagaatgatattaaataagtccatgagatactaatttctatcattgtgagtcctccttatattctttatagctcttaatggctattttacaaatacctctatttacagcaacaaatactataaatgataatagtgttataactgctcttacatcccctgtaaaaggtaatgattgaaagagcaaatagttttctaaaacactaatagctgtaatagtagttagatataatatagataataagtaatcctttaattttagtttaacaaatggttttttgtgctcacctgttcttacaataccataaagtattatgaaccacataacaggtactaactgtataataaaatcattgtctacatttaatgcatgtagagcgtaaataataactgcaggaatacctataatgaatgctagaaatacataaaatataattaacattataggaagggctacaagaaaacctagaccttgttttgaatactctaatgtgtttttacctaggaacttaaaaaatgttttattcatcttcttcctccttggaattactttctgtaattgtaatttctaacatattattgtaataatcattcttttgattgatattatagttatcattgtattcattaaagtctacataaatatattcatttgcgtcattttcataaataatatctatagctgtaatatctgaatatgctgtaatcatttcataagcgttcgtattatcaggataagcaaaaccaacttgaggtatttccataggcttatcaataagaataccgaaataagtacagtgacgtgttcgacttatacttgaagtccctttatatgtaccatagtaatctataccttctgtaatacctgatatatggaacctgcttacgtctttaggctctaatcttacaacatcgcaattctctaatactaaatcaatatatttgatattcattttaactctccttttatattaataattttttccattctttatcaacctttttaagttcttttttattatagtccccgtctttagttactacagtgttccattggaacttttgtaataagctaaaattatttataatccatatattacttttactataatacatattgtcttcaaatcttatatctttttctataaaatatttatatattttatatcttctttcatctgcacctgatattttaataatttcattagtatttaattgagtggataactggaagataacatcttttactttcaataggtctttaacattacctctgcctacatggtcattatagcaatcatatttaacttttttcttttgttttctatcattaactacaatgaatatattatatacgatataagctttaaaatgggtataggtagtaggtgcttctgaatcatcacattcttttcttaggtctgtacattgtatttttaatgtaatattatttgatatgttaactacagtagagccctcatgttttttattaagatttatcttatccattttataattacctacttattgtagatacaatgtactcgaacatcttccattactttgcctaatagattctgacctttccagttactttgctctaatattttagggtcatttgctttaagacctactccccatattttatcataaggtgaagcttctacaaaatctttacgtacatctgtgtctaatattctttgctttaggtgtgtagtcataaatttatctttaactacttctaccataatattatatcttactttattccactgttcttcattaaaattacgaactttacgacctaaacttttagcatggtttgggttcttagcatttagtatttcacctgctatttgaaagtcattaaagtatcttgctttgcgccacataaaggcttgctctgagttattaaatgttcttccttggtgtttaaactttatagggtagaaattagaataaatatcctctttaccccaaaacataatatattcccttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatgattactactctctataaatgcatttaggtcagcgtatagctgaataaaaaaggacatgtcataattccaatacttaggttcatttctacctagttttttcttcattttcttatattttttattcttttttatcccaaaaacttctttttcaaagtcattcaatttaagacctttaaaatattttttcttcatttcttaacctccaatttaataaatggaaaatcaatgtttctaaatactgcgccaacatcacacattaacatgtctccattaatttctacttctccactgtctgtaggggtgtgaccacatacataggtaaaaccatcttttctaggttgaaagtctcttgaccatattaattggtcaattgtttgttcttctacaggtttccaactaaccccacctgaatgagagaatatatacttgtcttctttatagtactttctacaattaaccataagtattttaaattttctatagtcgtctgattctttaagtttctttagttcacttttaataaaatcataattatttcttagattttcctctacactactatattttaaagttactgtactcacaccgtaagagttaagtgtttctatacaatatcttgagagccattcaatatcatagatacttaatcggtctacgttttccataatattataaaactcatcatcatggttccctaacagagttactacattatcatcattagacattaaatcaaatatatagttaacaacatcttttgaccttttacctctatctacataatctcctaaaaatactattgtttcttcaggttttctttcattatttattttatccataattgttaataatttttggtattctccgtgaatatcgggaacaacgtatatagccatctaatctcctccttattgtatataactatcttaccatacttagtaaaaaaagtcaataaaaaaacacctattaaattaataggtgtttatcatttaatgttattttaaagtatcattaccatgtgctaattttttatcatctattgcatggtcattataaatatatttaacctctatatactggtcttcacttttcagtgcatctactatagaagcattattagttattgagcttgttctagggtaagtaaatttttgaccgtcagataaaataatagtaacatcaacttcaaagttaacaggtagtctgtatccataatcttccaaataattaataaagttattaagagaaaatggtttatacttgccatctaaggtatagtcaatatattcatttaatgcattagtaagttctgattctgttaactccattgtatcataatctttttcgttatagaatactacaacattaggttgttctatactagaatctccgtctttatacttagatataaaaaatccaatatttcctttatgctctaaataatctgctttcataattttaagtacttcttctgctataggttttgctaatagtgttacccattcacctttttctgcgtcataaacactaggtagtacgtttaccatcatttaaatctcctcttcttaatttattggtttaaaccacaatttactcttatcacttggttctgtttcactaactacgaaagagttagaatcaatgtttaaagtattaaaaacaatttcttgtttgtcttcattactttttgttgtaaattcgggaacatctgttaatatagactctttaccattaatagtccatgatattttaaaagacccttggctatacactgtattcggtgtcagtttttcaattataattttagcggatgcacctgtaattttttctgaagattttaataatttacctttggaatcatataagtttaatgttctctccacaaattttatctcctttactatattttgtacaattaatataacaaaaaaacacctattagtttaaataggtgtccgacagagctcccgtacttagattacggttaataatattttacgacaactatatgagaccctctgtcgttgaaactcttgtcactgcgttattccacaagatattttagaaggtagcttgtggaagaagattgtttttaaaggtacaattagcgtttttaagcctattcgatacccaggacactatgtccgtactaactattacgtcaataaaggttctacggtctcaattacctactctttattgttaaaactaaaattaagcttgagtgctctagaagccaaaatcaattaattaactatagatacggaatggaggggcactaccatccggagtctacggtcagatacaaagcctctgccgggcaacatacggtatctctcgtacatcaggttgactagacctttagagtttttcactccttctcttataaccagtaacttaagagaaataggttttacttagtagatatgaaacaataaatccacatacaatattaaatcatagtcaagtgattgcacatatgtctaacacctataagttttttgctagcctggtatatggactctgcaggattcgaacctacagtcaaaccgttatgagcggttggctttacctttaagctaagagtcctagaaatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcttattctcattataaggttaaaaaggctaactgtgtttagcattatataagaggctttagttaactactatactaataatataccataaattatacttaatgtcaagttaatttatcaattgaatctataatttttgatgtgctacgtatatctgcttctttactatgtttaaggagatattttaatttcattaaaaaagaatttttttctttttctataatatcttctttatcatcatattctgaaaacataatgaattctatacctatactatttctattatgtgaaaacatatttatagaaaaaggtgaatcaaaatttttatcatctttattaatactaaagtcttcagtaacctgtaagtcatttatttcagatatttcaaagtaaccattaactcttttaagttcaatataactattgtatctaaagtaacgttgttcttctattaacttctcttttgttatataaggatattcatttatgaatataggattacttgttccatagttatctctaatatattctgcatcctctagggaatcagtataacctaaaatttcataacttgttgtatacactgtatcttcttcccacaagtcatagtccatttcctctatttcttcttctaatatataaatttttttcatatattactcccaaaccccgataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcggatattgtcctagcattcttgttccattttcattataaaaagtatattctactacaataatattcatcatatctacatatatagcttctatatacggtgtaatattttcctcttcttgtatgtgtttacctatgatatcatataataattctgagtgtattcgtttatctctcattatagacctccgtaaggaattctacagttttgtctttcaaagatttttctactaattccatagcatctttatagtgtttgatattagattcattagacttaagtttatcttttacttcttgaattaggggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagttaattctcctttttttagtatattattaatattaccgataacagaatatgctataggcttaaaattagctctaacataagttaaaaatataaaatcatcataaaataaatctaaaacagttttattgaatctagtatttttagcttgctctaattgagcacataaattaagaacattatcaaacccactttttagaactaaagagataaatctttctactgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaagttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagcaatcctccttaataaccatgtttagttacccaccctgctaaagcatccatagctatatcatattcttcttcatttttaattcttataattttctctatttcttcctttgcttgcttagaactaataaaatcaatatcagtatcctctaggttagttaattctaagttttctctaataaaattcttttgacttggtgttatagaattaactcttacattttcgtgatttagaaattggtagaagtccatattactcatcctttttaacgtattctgccatatcttttaaaatacttagtacatactctaaatctctatattggtcatctaacgaacctataatagcatatggtgtcatatcccaggcatgtgcacagtcaaaccctaatactctcttaccctcatagtcataatcatcgtaagtgatacctctatgggcacgtctttctaaggagtcatattctttttcattgatatctgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataattagtcatctcctttttatttatatctttactatacactattttttatattttgtcaacaaaaaaaggctactaattaaagtagcctaaatattaattatttagcgttataagaccaacgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttattcctcctaattattcttacagtactaatatatcataggtctttttctaagtcatttttaaaagtttcctcgtaagaactagcgtaagtaacctcataacccactacgttagtatatcctacatataatgacttataattagattttatcttaatatcttctgattgttctagcttatttaagacttcacctaaatcatctgaagaatagtgttcattatctattgttattgttttaccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattactaatataagagaaaagcagacttattaaaagtctgcttctgtacctaattctaatcttctatttttcatatgaggaatcatttttttatctcctgttaatagagataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagttccatcttcattttctttaaatttatgagcatcataaacttctactttatcacctaatctcaaatcttgagttaagttatgtttaccaataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgggttacagttaagttatatgacccatcactaacatatcctaaatcaatatcatgtctaaaagccaaatcttctaaatgttctaataaatcgttcttttcattatgtttttcttcttctgtattatttttaattgggttaattaattctgtacaaacaatatcatacaattcaccatctgtaacctcatagttcttttcaattaatacatcttgtattttattgattgaatttgtaactactttcccatattcttcttctgtaaacttacatttatctaaatcaacatctgtaattaattctgcaatccatttatttaaaattgatactgccattgttcgagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaagtttaatcaggtttttcatagttactctaactccttaagtttattttttactttctctttatcgtacttataatctttactagagttttcatttttttctttctcttcttcattaagttctctatactgagcttcttctacctcttgttctttattatcgttatcttcttctgctttttgaatttctacattcttactactaccatttaccttttttctaaaaagaaaccaaagtattaataaaatgatgagtaaaataacaatgctcaatacaacagcccaaatattattagccattacaacctacctccgaatagtttttttacagctcttaagttttcagatgaatcgttatttatatcaattcctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcatatcctgaatttgataacttacctaagtaaaggtttatactatatccttttgtttctaatgtttgaatagcacttaacattatagcccctctgtaagcaagattttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatctgatgaattatctctacctgaaactctattcttttttaaagcagaaaagaaatcaggtagaccatcatatttaattacatttaattctgagttatctattaatcgtctacccattgattttcctcctattctaatcctaatttatccataattgtatcaaagtccattgaatcttttgatgtactatcagattttctaggttcctgcttaggctcttgttgcatacctaaaagctttcttgttgcttctgtgtatctgttaccctcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagttaactaggtcttcattgcttgataactgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgggtttcatgaaacttaccatttgcatcaataaatcctgttaatttaaattcttgagtaattgcattactgaaataaaaatctaaatctagagcttctgctacttgttctaatacatggttcttacctgaacctgctccaccttttaaaaatactggaatattttggttaactaactttagtatatcttggtatctataatggaagattcctgagatatctttaattgttttttccttcttgttgtaattcaattttaactggtaaattactaagttgttcttctacatattcttcaatttgttttttaacgtcagtaataataatttctctactctcagttcctgctttctcaacaattgcatctacaattgcttgttcatacggattagagtttttctctcctagtttgtctgccaagtcttttgttgtttccatttgttgttctaccaatctctctaatctttcaatagtatcttgctttgccatatttatcattctcctttgatttgttatacatttattatattacaagtatttgtatttgtcaacaactttctaaaactttttttagttgttaataaaaaaaaataccttacacctataacttaacatagggtaaggtaattgtcaacacttttattaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcctaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttatagtgttcaggtaaatgtgcatctacttgtatattataataatcttctaaaagacctatactttcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaaacaccctgcttggctacaagcaaggtgaaaaaggaaagatattatggaagtgtactatctaagtacacctcataatataacagttttccttgctagttattacttattttttaaggtcttcttctttgacaaacactccattaataagcttaccttttctgtcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataactttaacatttgaccttcaggtttacctgtttgtaaatttctatcttttgcccattgtttaataagttctactttttccattattctatatctcctttaatttctgtatctttgataattaggttatcagagtcacttgttacatttaaattatcttcaactaattcatgtagattattagtaatatcttcttcatacctataacctacacgaacataagctttaactctgatatctatattaacataatcttcttggaatttttccatttctaacttcctttattatatcatattatgatactattgtcaattaatctgagtagtttcctttagcaagttgatactttttgtgtaattcttcatataattctctcataccttcatagtttctcatatcatcttccaagaaactaaggtaatctaataatacttttacatcctcaggttctaaagttataactggttttaccattaggcaacctccttaaattcttctttatttattttcttgatatctttttctaatgcttcttttaattcattaggtaatttataggcatcaattgattgttgttgacctaatacataaccattatctgtaatacgtatttccactgtaaaccatgaattatctaaatcttcttctaatcttgctaataatattaaacaactattttttagaattctgttagcatacccaccaacacaatgagataacattttaccttcatctttaagtttacttacagtatctgcaggaaggaattttacttttctaccatcttttaatttataagttttatcaattattttttctaatttattatcatatttagctttaagttctgcatcatctaattgttgttgtatagattgtttctcatctgtaactatatcatgttctagttttagtgaaaatggtgttaaactaacactctctaatgttctataaccttctcttattaatattgataaatcatgtaagtaatctaagtaatagttatctagtgcatatcctgttatacgttgtctgtcttgagcatctacatctaaatagtgcgtcatctttttgtaattagcaaaagatatagataatatttgattcacaataggtttaacttttaaagcatctgtaacatctcttgaatctctaaccattaaaaaggtatcgtcaaacaattggtgtaaattaacttcattgtgtaaatgattatagtgcttatagagaatattagcaaatcttaagtaattaccttgctcaaatttatttaaagttagtaactttttataagtctgttttgtaagattgaaggcttcatgaactttccatttaggttttttaggtatatggaatagtaatgcatttctttcaaataacccaaattcttctaagttatttattttatcaatatttttaacaatatctgttaaagttattaagtaattagaagttgaattttctcctataaaaatcctatatttatctcctctataatttatatgaccataaacatctgtattatcaggacaccaactagaaaaatcaaaattatggtgctctaatgtttgttctattatctttattataattcctctagttaagttaggttgtgcatagttttttaaaataacatttaataaaacagataaagttaattcattcttatattcacttttactaatatcatctttatataggtttaaagttatttctttattaacaagactatctgttaagaaaaccttaacttctcctgttttaacgtcaaatgaacttttattttctaaaacccatttgttacccatattatgtttatctctaatatgtttaactttaagaccaaaagatgaatagttttcagtacttggatgcatgtaccaaacacggctatataattcatctgtcatagcactatagtactcactagaacctttttctatatcttcattcataacaataatagatgactttataagaccatatttaccttggtctagtacatccataatatcattatttaaactatctactacttttttatattcttctaattgtctagattcattcctccataaatggtcattaccttctagttctttaattttttcttcaacataaccttttgattgtatacgtcttctactcttatcaccatatacaggaaaatcttttctttcttctctattagattcaatatactctttgtaacttcttcctttattatcatcaactacaccttcaactaatttttcaactgtttcataagggttaccttcaaagtttgttacttctttattaccacatagggctaaaaataaatgtatttctgtggctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagtccttctaaatgagtttcgtatataactttttgaattttatttaatggttctaaatctaaattcataataagttttttatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataacttcttctttcttttctatgctcatttataaacctcctggtctactctacacaaacaagtacgtattctaaattagttaaagaaactgatttaatattgtttaattcttgtaatttcttaatttccacatcatagttcttacttatagtccataatgtctctcctgctcttactttgtgataatatttatttccctctttgataaggtcattcaatattacctacccccttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctaaggttaaattaagacctacagatactatttgaaatactgaagcatcagttaataataagttgtaaaaacttatacctactgtagctacaattaaataccaaaaatagttactaactcccttgacactttctgctttaactaatgctactaaacctggtatatatcctactgtaattaatatagcatataatatacttaagtaatgtgataaattatccatcttgttcccctaatttctctaatctattaataacttcttcccatgaaataaatccttctccgtctgttagttctaaaaccataccatacacaaattggttcgtactaaattcagctctgtcagggtcattgtatggtttaccatgtccttgtctaatatccgagcagtagattaatacgggtttatttacaatgttttcaagtttatctactattaattcttcttcagtatttaatgacgtttcaaacttatttgtaaaataattaaaatactcttctccattatcatatatatggttaattgtttcttctgcttgatgtttcatacctaataaaataccgagttctgcaattgttcctaatccttcattaaggatatcaaatacaaaaatatctgattcttgcatagccttaaagtcattagttaaaatacgttctgctagcttagtttgttctgcattagctttatcatttattgacttatctttgtgagggctataaggagttactcctacaatgccatctacttctttatgttgtttatctctgtaatctaccatagcttcatttaggatatgtccacccatataaattactttgtctttaattttattacccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagatactagcaaagttttaactgtttttaaccctaaatgatgtgcaattacattcatgtcttctactgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacgcttgctaaaaatgctaatactactaaaccaggtaaatttaaaactgttgataagaataatgatattgcacttataacataaactagaccgcttagaaataaagttaataatacaattgttataagtttcaccaaccaattgttattaataaataccttagctaaataattcataaaaaaatcctccttagttattatagaataattataccataactaaggggatttgtcaacatattattttaccatttaaaattatctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagaattttttgtatgaacccttgtaagaacttttttaagttcactacgtttaaagttctgtgcttcatttataattatagtagcatctcttagatttccacctcttaggaatagatgggatatttgagatacccaacaatctcctagtttatcttctttaacattatcttccatcattaacatttcagttatttgttgttcaggattcatattaagttcaataagggcatcatgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctattactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaacactttaacagaatctacaactacactgtagttactaatagtaggatactctgtataaagtatttctacattagtattcatataactatcaattacagagttaactgtatctctttttagctcagatacattatgttttcgtatagtaggaaattcttcatcatattctactaattcttttctatctgtattcaataacttgtctaaagaggacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagatgcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaaagactaagaaattaatcttagtcttaatatattaataactattatgtgcgttgtggtatgcaagagctcctgatgttgaaccgtaacggtcaatcatatattgttttgcacctttagtttgttctgctatagaaccaccactccatgatttacctaatccttggaataatccttgagctcctgatgatgcattaacagcattagggttcattgtagattcacgcatagcaatttcaatcattgcctcgtctccacctgcttgtctaatctgttctgctacagagcctcctgtagaactagttgattgtgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccatcactaaaagagaaatcataattacctgcttgaattggttttgtatttacttctgctgaatttgatttagcttgttctgctaacttattataatcaatttcgtctgcactagcttcatttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaagagaggtaattatatttaccactctccagtttcattatatttatttattacattatctcttaattctatagcctcttctaaagattttgcactaaaatatttaactttattttttcttacaatttgtatattatatacattatttgattttttgtatatattatgtgtacttttctttcttatattagttgagttttcagacctagtagaccacttaacattaccaggttcataattaccatcattatttattctatctatttgataattttcattcggagggtctcccatatagtcgtagaattttttaaaatcattcttccattcttcacatatttctataccccttcctccatagtttttataatttatagcgttaacatcgtaacaacgctgtttcatacctaaccatctttggtacattgggttactggataatccatgggtagtattcctttctctcattaactcactatgaattttattactctcacacccacaagattttattttaccttgccttaaagtggagcttctaactattattacttctccgcattcacataaacattcatacattttacatcttgatttatccctcttactagactcttttataacttttagtttattaatagtttctccaatcataatatctcctcctataataaaactatagcataaaaaaccacctatgtcaataggtggttaaacatattatttatttaagtttgtaataacactatctgaacctatactaataggttgttttccattccatttttcaattaattgttgttgtaaaacttcctctgttaaggattcacttctaatgtcattggctttcttttcaccttttgcttcaatttctttctttttagcgttttcttctgctatttgcttatcaactttagtgcgctctagttcttggtttgcttttactctctcatcaattgctttttgagtatttttatctgcagttgggcttgataatgcaatatcatcaataataaaaccttgcttttctaaattatcattaagtttatttaaagtatcttgtttaatttctcctgtttttacaccaaaagcatcaattacagagtacttagaaattgcttgtctaacattatcttgtactctagaacgaagataccctttttcaagttcttctatgtcagcacttccgaatctattaaaaaggtttactgccttagttgcatctactttataagatacatcaatgtctaatttaatatttttaccatctgaagttgctacatttaaatctttatatttatgtgtttgtgttttagttgggtatttatttaccttatcaaaaggtgctgttaaatgccaacccggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaatagacggattttaaatccgtctaaatttatattctatttgaatactccccaggcaacgccaggtatttgattaggtggaacaccttgacaagttctaacagggcaatatactctgttaccgttgtaagcattataacctatccaaatgtgacctgcttggatacaaacttcgtcatatacaattgtagcccctgccggtaagttaccgcctactggagcatttaagaatggagaacctattctagttactataggttggttaccattgacaaatgttgcattttccggtttataccaagttccgtactggttctttttccaagaacctgtaactggtctagttgccggtgtacttgcgctacttgttttaccatctttaactactgtagaacttgaagttcctttatccatgtagtttttaatttgtttaatgaaataatcttttaatttattcattattgcttgtgatggtcttccttgtgttactggattaaatcctgtatgaagaaccatagaacggtgaggacaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatccgattattcaataaaagacgtaactcctttaccggttctcttatgaactccttatagtttcctataagactagactatatcttcaccctaattttgttaggggttctccatttcgatttaagggattctcacccactccattaacttgagccctactcctattgacgatttatttttattggcactcgtccgagggatagtcgttgaaccttaatattgtttccaaatgtatccgtaggctgtttttctctctcctttgatacatcttcctatattaccacttcttttattagaaatacctaagaactctaaagcctcttgagctgtgtaaaagacattcaataaattaccttctaagtcatactgagctatattataatttatttcattttttaatcctgtctttattgcatgttctctgttctcggaattagaaacccattctaaatttcctacactattatcatttttaccatttaaatggttaacttgttctttattatcaggattaggtataaaagccatagcaactaaacgatgtattttaggtgaatggtatcgtaaccttacaaacaagtaacccttgttatttttttgaagttttaactttttaggctctttacctttataagatattacttctcctttatcagtaatagtgtaattttcatatatttctaatccaggtatttcatttaatttcttttccataataacatctcctttacttaagtatataggaaagttattatgttgtcaagtagttttttaaaacaatattcttggatgctgattagcatagcttgatagccttagcctcccagtcaattaaaagaactttcattatacattactgtataacagggcaatttatttacccgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggcgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcatcaatggctcctgcttccattacaccaaatgatgggtcataacttgtagcttttttaactctgtaagggctatctactgttccttttgcataagcatctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagtgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctataatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattctttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctacttatactgataacctctattatctaacacatttctgtgctccaactacagttagtcgttacagcgtatctttctaggattccgctaagaccctaaaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaatttcaaaaaaattatagaagtagggacgtttacctacttctatttaatttacacaaggatgataacattgttattgttttatactggaaaacaatgtaataaaaacagtgatgtgtaaggtatttgttttattgttaattatattatagcatatactgatacctttgtcaagttaatttaatactttttttaaaacattagttatcttttgttagttcctcctgaatagcatcccatcttctttctgcttcactacgattatcttctatatgttttgtagttttacaacatttgatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaagaatactttaatatcaagggttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtatcagtacttacaggcaaaaaagtacgtatttagaaaataaggagctctcctattatagttatatatatttattactattattaattactatttaaatatataattataattaacaatgttagaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttcttagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaatgggctagtgcatctttaaactctaacttaaggatatccttatatttagtcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaataatagaaagtaattatggtataacagcagaagagataaaagttagggctaaagcacaaagaagagtagaggaagatagtaaaaaggaagattacaatgaaaacaaagaaagaaattaaagaacaaaggaaagaacttaaggatggtgctacatctgtttctttagtaaaaaagggagataagagaatagctagccctagtagaatttgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaacaagaaaaagttagaagaagaggatacaagaaaatatatagctgatgggtttatgaatggtatcggtaaattaatgtacgaatttaataagaaagtagataacaaagaaatagaagttaaagacccgaatgatttatacaaattatttgtgatattctctcaaatgcaaaatatggtcaatgaaacttctgaaggaggagcaatacctcaactatctagacctcaacaggaattatttgatgagattacaacagaagatagtaatggagaatctacagttgatttacagaagatatcagaaatgtcagcggaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaatccttctacctatatgcttaagtatcatacactgagagggcatcctataacttttagtattcctaatagagatagaagtaaagcacaggctcatagaccttggcaaactaggattgtaaatgatactcatcctaataaggctgtaataaaatcacgtcagttaggtcttagtgaaatgggtgtaatggaaatggttcattttgcagatatgcatagttatgctaatgcaaagtgtctgtatacattccctacaaacgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtactgtagagggtgtggatattgactatttatctttagatgagtatgacagggtaaacttattagcagaatcgtctgcattagaatcaatgtcttcatcaccttttaagattgtgagaagatggagcacaccttctgtacctgggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacagaatggcagttaccaatttgtttgtcaaaaatgtggtaaaccactagatagatggtataatggtgagtggcattgtaagtaccctgagcgtacaaaaggtaataaaggggtacgaggatacctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataatgttttaaaactcattaatcattttggaaaagataaagtatttggatgtacttataaatcttctcctaaatctaccggacaattaagacctgaatttaatgagaacaataatagggttacagtggataaattaatgcagaataaaagatatgtacaagcacttaagacaaaggatataagtgtttatagtacagtagatgatgatttaaaaactttcttaaaacattggcagaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatactttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagggctatttctaatggtgaagaaggaaaggtaaaccctaaaaaggtagcaaattcattatctaatttaagtaaaaaaggtgtagatgtatcacatattaatacaaactcatcattgtataaagagtttgttgatgataacggtgatacattaggaattacatcttttaaacgaactgaaaatgatataatattagaatcttatgcaagttcacatgattcagatggtgtaggagcaagagctattatggaattattacgtttaagtattaaggaaaataaaaatgcagttgtgtatgatatagaattacctgaagcagtagagtatttaaaaactttaggatttaaacctaataaagatggatacatcttaagaaaaaaagatgtaaaacaattcttaggtgattatagtgattttatttagcactatagtcatctattctattgtatttattctatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagcaaagaggagaaagaagatagtattaaagaatttagcagtttattatgtgaaatggtaaatagactatataagtcttataatgtatttagacaagaccctatggatgaaactcaacgtctagatggctctttaatggtctttcaaagtagattaaatgaccctttaacaggagatttacatgataagatgtataaacttgctttttcaaaacgtattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaacctgaacctgaacctgaacctgaaccatctgaaccgtctgacaatcctgatgaaaatggaggatgggaaactgaaccaactgaacctgagtcaccttcagagccggacgataaagtggacgaagaagataaaaatgaagatactacagatgataaacagcccactgaacaaccggacgataacaacatagataatgaagataaaactgaagaggagtaattactcctcttttttgtttgctatattaaataagagctaaatataaaaaaattgaacattacggtggtgaaaactttgttaggaatgaatattataacgtcactatcagtagtatttacttgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttactataagttttataggtgcaatacttggaggaatttggtacaagatgatgaaaattattaaaaagagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaggtaatattagtagataaagataataatatactattagaagattatgatattgttatggaaagtaagaagatgttttattacattgaagaaccgttcgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaagaacgaacataacttacatgatgttttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaagaaatgaaacgtatagaagattttattgttaatacaggtaaagataaagatgtagatagagattcatttcaaactttctgtaagaaaattgttagagatacttacatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagagttagctatgggtataagaaaccctagaactgaattatcttcttcaggatatggattatcagaagtagagatagctatgaaagagtttattgcctacaataacactgaatcatttaatgatagattcttctcccacggtggtactactagaggtattttacagatacgttcagaccaacaacaatcacaacatgcattagagaactttaagcgtgaatggaaatctagtttatcaggtatcaacggttcatggcaaataccagtggtaatggcagatgatattaaatttgtcaatatgacaccaactgctaatgatatgcaatttgagaaatggttaaattaccttatcaatattatatctgctttatatggtattgaccctgcagaaattggtttccctaatagaggaggagctacaggttctaaaggtggttctactttaaatgaggctgacccgggtaaaaaacaacaacaatctcaaaataaaggtttacaacctttacttagatttattgaagacttagttaatagacatattatatcagaatatggagataagtatacattccaattcgtaggtggagatactaagagtgctactgataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaaggcaatgaagatgaggaagttgaaaaatcagctaaagaatcaaaagaccctgtagaccaaaaagatactaagacagaaaataaagacaacgagaaacgtaaaaataaaaaagataaaaaagaagattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagtcaaaggattaactaaagaacaagaaaaagaatttgccaatgttccaggttttgaatttgaagaagaaaagaaaactactagaaaacaatcagcttctactagtaaagaagaagagcctaaggaagaggaaaagaaagcctctactagaaaaactacaaatactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacacatagatgtaagtgagatagataatttaacattagctgattatggatggtcaccggatgcagttaaagcatatatgttcggtattgtagttcaaaatcctgatacaggacagcctatgggtgacgagttctataaccatatattggaaagagcggtaggtaaagctgaaagagcattagatatatctatactacctgacactcaacatgagatgagagattatcatgagacagagtttaatagttacatgtttgtacatgcttacagaaaacctatattacaggtagagaacttacagctacagtttaatggtagacctatatataaataccctgctaactggtggaaagtagagcatctagcaggacatgttcaattattccctacagcacttatgcaaacaggacaatcaatgtcatacgatgcagtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgccccctgagttagaacagttagttataaaatatgcattgaaagaaatataccaagtatggggtaacttaattattggtgccggtattgctaataaaacattagaagtagacggtattacagagacaataggtactactcaatcagctatgtatggtggagctagtgctcagatacttcaaataaatgaagatataaaagaactattagatggtttaagagcttactttggatataatatgataggattataaggagggttagaaaatggaaaaaccgtatatgataggagctaactctaaccctaatgttattaataagtcaacaacatatactactacaacacaagcagatgaacaagataaacctaagtatactactagactagagtttgatacgattgacatgattaggtttattaatgaccgaggtataaaagtactatgggaagaagcatatttctgtccttgtcttaatcctgatacaggacatcctagagtagattgccctagatgtcatggtaaaggtattgcatatctacctcctaaagagacgataatggcaatacagtctcaagagaaaggaactaaccagttagatataggtatattagatacaggtactgcaataggtaccactcaattagaaaagagaatttcctatagagacaggtttactgttcctgaggtattgatgccccaacaaatgatttattttgtgaataaagatagaattaaaaaaggtatacctttatactacgatgtaaaagaaataacttatatagccactcaagacggtacagtctatgaagaagattatgaaatcaagaataatagattgtatttaaatgaaaaatatgagaatcatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgtcattgtactacaagacccttataaagttaatgatggtatagaagaagacctagaaattcaagtagatgaccctaaggcttcggcatctaatcctagtaatttaggtggattcttcggaggtgcatttaaataatgccagttcatggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttatctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttatcaagatatgagaactttaaaagtagataaaggaacaggttcagtttcgaagataactgattacctagaaggacgtaggaagaatgtaagccacccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagatactttagtcgaatcttctacagcaataagagaagatgataagttagtttttactgtttctaaaccaataggagagttaataaaggtagaagatatagagtttgctaaatacgataatcttcaggttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgagggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactattcacaagctaaacgtttattccgttcaggagaattacttgatgcaatagaattagcatggggttctaaccctaactatacagcaggacgtattttagctatgcgtatagaagatgctaaacctgcttcagcggaaattggcggattaaaaataacatctaaaatctacggtaatgttgctaacaacattcaagtaggattagaaaagaatacactaagtgattcattacgtttaagagtaatattccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagcaaattagataaaattgaaaatgcaaatataaaagataaagctgtatatgtaaaagcagtttttggtgacttagaaaaacaaacagcttacaatggtatcgtatctttcgagcaacttaatgcagaaggagaagtaccaagtaatgtagaggttgaagcaggagaagaatcagctacagtaactgctacttcacctattaaaactattgaaccgtttgagttaactaagttaaaaggcggtactaatggtgaaccacctgctacatgggcagacaagttagataaatttgcacatgaaggcggatactacattgttccattatcatctaaacaatcagttcatgcagaggtagcttcttttgttaaagaacgttctgatgcaggagaaccaatgagagctattgttggtggaggattcaatgaatctaaagaacaattgttcggtagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattcaaaccactacgtgtaagttcattagaccaaatctatgagtcaatagacttagatgaattaaatgaaaatggtattattagtatagagtttgttcgtaaccgtactaatacattcttcagaatcgttgacgatgtaactacattcaacgataaatcagacccagttaaggctgaaatggctgttggggaagctaatgacttcttagtaagtgagcttaaagttcaacttgaagaccagtttattggtactcgtactattaatacaagtgcttcaatcattaaagactttatccaatcttacttgggtcgtaagaaacgtgataatgaaattcaagacttccctgctgaagacgtacaagttattgttgaaggtaacgaagcaagaatttcaatgacagtttacccaatcagaagcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagacatcattgatattttagtagtagataacttaacgaaacaagttattatctcatatcatggttgctctgcaaataactacaatgaaacttggcagacaaatgaaattgtaacagaagaaatcgagtttagttacttaacagcaagtgacaaagcacgtacttaatagattagaccaactaaaaagttggtctttttttattgacactttaaaatttatatgttattataaatataataatttaaacaggagatgtactagatggcaaataagagaaaaacaataggaaaaatgagtaacacaagagcaacatggaatattaatccggtaactaaagttaaaaaagataaaacaaaatattctagaaaaaataaacataaaggtcttgacaattataattaactaaggtatattattagtataacaaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaggttaaaggtaaaccaacaacaaatatacctaaattaataggttttatttttaaaaataagtttgcctacgaaaatatcatagagtacaataacacagattataatggtaatattgagaggagaattgttgttaaacatcctaaagttataactgtagaaggaaaacctagctatcagtttttgacaattagtcttgaagatgctagagttattacggtgtggtataacagtgtagatgatacacatagaacactagatttaaattattatagtaaagacttgacaattcaataaggaggtattataatgggtataacaatagtaaatagttattttattctgtctagcattttcctcatcatattaaccatattaaatggtaagggtacagttacaagggaatcattaactatgagtaaaatattagtagtaataacatcaattcaatttttagcatgtttaattattaatggtatttattggtcactaaaatttatgtagtagaactagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggcgttaatgatacttgggaaaaagaatataactttgaagaactagacttaagatttaaagttaagattaaattacctaatgcacgagaacaaggtaatatctttgcgttacgttctgcttacttaggtggtatggatatgtaccaaacagaccaagtgattagagcatatcaaatgttagctaccttacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctaccgagcaaagatttaaggacttagacgattatcagatagagtttattattgggaatatgaatagagatgtttatgaacataataaacaacttaaacaagctcaaaaaggtggaaaattcgatagtcaattcgaagatgatgatagtagttggtggaatgaatctcatgaagactttgacccagtacctgatttcttagatgctgatgatttagcacaacagatggaagctaaattatccgatagagataaggaagaaagagctaagagaaacgatgcagagttaaatgatgaaacagaaggacttactacacaacatctagctatgatggaatacatcagacagaaacaacaagaattagatgatgaagtaggaaatggtaagactagtgaagatgacgctactatatcacaagatagcgttaataaagcactagaagacctagatgatgactggtatatgtaaagggtggtaggtgatactaccatccttatttttttaaaatggatggtgaataatgatggcaatgaatgacgattatagattggtcttgtccggtgatagttcggatttagagaatagtctaaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgctagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgtttgacatatgaccaaggtgcacgagttagaagtgaactaggtaaagtaagttcttatgagagccaaagaaaacaaaaccaacgtaatttggaacaagcaagagaacaatatagcaactatagaaaccaacaacaagacttgactaaacgtagagctagcggtcaaattaataaggcacaatatgaacaagagttagcttctattaaacaggaaatgaaagctagagaagaacttatatctaactatgagaaattaggagcagaacttgataaaacagttcagtattataagggttcagttcaaaaggatttccaatctagagacgtagaccaacaaagaggaacatttggtagaatggttcaagaacgtttgccatctattggttctcatgctatgatgggtactacagctatggctacaggtttatacatgaagggtgcctcactaagtgaaactaatagacctatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggtggagtaaattctgataacatgaaggaaatgcaagatgcattcttaggtggtattaaacaatcaggcatggttggtcgtcaagatgaacaacttaaagcactaggttctatagcggaacaatcaggagaaggaagaactctaactaaagaccaaatgagtaaccttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatagctactcaaatgggtggcagtgaaaaagaacaaaaatacctatttaatagaagtatgaaagaaataggcgctaacctaactatggagcaatctgatgaaatatttaaggactctaaagaaggaaaactgtctaaagaagagttagctaagaaagctaagaaaatggaaaaagaaggtaaaaaagaaggagaagataacgccactgattataaagaatctaaatcaggaaaaaatgaccaaaataaatctaagactgatgataaagcagaagatacttatgatatggctcaaccactaagagatgctcatagtgctttagcaggtcttcctgcccctatatatttagctattggtgctataggagcatttacagcttcactaattgcatctgcaagtcaatttggagcaggtcacttaattggtaaaggagccaaaggacttagaaataaatttggtagaaataaaggcggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggctttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtattctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaacggagataaggatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggcgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggggctagaaaaacaggattagaaaattttgctaaatctaaaggtaaaaaatctagtgacatggatgttcaattagattacctatggaaagaaatgcagtctgattatgaaagcaataatcttaaaaatgcaggttggagcaaaggtggaagcttagagcagaatacaaaagcatttgctactggatttgaacgtatgggagcaaacgaggctatgatgggtactcgtgttaacaatgctaaggaattcaagaagaaatacggaggctccggtggcggaggtggtggaggagccctatcctctacttaccaagaagctatgagtaatcctgtattaactactggttctaattataggggctctaatgatgcttctaatgcttctacaactaacagaataaccgtcaatgttaatgttcaaggtggaaataatcctgaagaaactggagacattatcggaggaagaattagagaagttctagatagtaacatggatatctttgcaaatgaacataagagaagttattagtaattttgtattgacacaagagtagtatcatagtatactactcttatacatataaaaaataaaaggaagtatgtgtatatgcgtagaataagaagacctaaggtaagaatagaaatagttacagatgataatacatttacattgagatttgaagatacacgagactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccctaacgataaagaaggaaaacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattacctgaagtaggttggcttattgatggtgatggagataatgaagtaaaatttactggtagctcagctcatgaagtaatgactggtattatacgtagatttataccttatatgaaatataactatactgaaaaaacatataatacaattgataactatcttgattatgatgatttaagtagttgggatgagtttgaaaaacttacagaagtttcagcctttactaattttgatgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttctaaaccacaattccaccctgaattaactgatagatatggttatactaaatttgaagtagaaaatatttatcttagtacaaaatcaggttcagctactgaggattcagattcttcaggtgatgataatggcacagaacgaggaacttattctaaaattatgaaagatttaagtaactatggaagagataatatatctaaaggtatagataagtatacaagtaaattatcttcaaaatataaaaacttaaaaaaagcccaagctaaaaaaattatagagaagtttgttaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttattagatgaatatattaaatataaaggagagccacctaacgatgaggcttttgataaatatcttaaagctattgaaggtgttagtaatgtagctacagacacaggttcagatgcaagtgatagccctttagttatgttttctagaatgctatttaattggtatcatggtaaccctaacttctatgcaggagatattattgttttaggagaccctaagtatgacctaggtaaaagattatttattgaagataagcaacgaggagacacttgggagttctatattgaatctgtagaacataaattcgattataaacaggggtattatacaactgtaggagtaactagaggtttaaaagacgctattctagaagatggtaaaggtagtccgcatagatttgcaggattatggaatcaatcatcagacttcatgggaggtcttatgggtgaagatacttctaaagaacttaaagaaaaaggtgtagcagagaaacaaagtagtggagataaagatggtggttctgatagtggtggagctcaagatggtggctctttagattcacttaaaaaatataacggcaaacttcctaagcatgacccaagttttgttcaacctggtaaccgacattataagtatcagtgtacatggtatgcttataatagaagaggtcaattaggcatacctgtgcctttatggggggacgccgccgactggataggtggtgctaaaggagcaggttatggtgtaggtagaacacctaaacaaggtgcttgtgttatatggcaaagaggagttcaaggaggtagcccacaatatggtcacgtagcgtttgtagagaaagtattagatggaggtaaaaaaatatttatctctgaacataactatgctacccctaatggatatggtactagaacgatagatatgagttcagccataggtaagaatgcacaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccttatgttggagtaatacaaagccttaaccctcagcatgttcagtatgaatcattttctaataatggttatgatatagaggcagaattaagtttcaggaaagtaagttatttagttgataaagggtctatacctacagattctttatctactttaacagttcatttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcatatcctatgaatattaactacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcggatgatttaaatgtaaaaggattagttttagctacagttagtaaaattaattataaatatcaatcagtagaagttaaagttaacaatttaactctaggaagccgtataggtgatgatggtagcttagctgtaccttatcctaaatctttcataggaagaacacctgaaggaagcgtattcggtacaaaacctcttattactgaaggttctgtagtattaatagggtttctaaatgatgatataaatagtcctattattttaagtgtttatggtgataatgaacaaaataaaatgattaataccaatcctctagatggaggtaagtttgatacagaaagtgtttataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggagttttttatgatgatggcacgccggataatcatataactactttatttatatctgaaagaggggatataagagcctcagttttaaatacagaaacacagaaaagaactacacaggaaatgtcaagtgatgggtcttatagagttatcaaacaagatgacgatttaatgttggatgaagctcaagtttggattgagtatggtattagtgaagataataaattttatattaaaaatgacaagcataaatttgaatttactgatgagggaatctatatagatgataaacctatgttagaaaacttagatgagagtatagcagaggctatgaagaatttgaatgaaatacaaaaagaactcgatgatataaactaccttctcaagggtgtaggtaaagacaatttagaagaattaatagagtctacaaaagagtctatagaagcttctaaaaaagcaacttcagatgtcaatagacttacaactcagatagcagaagtgagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatctcagatagaggagaacatataggtgctatgatacagttagaggaaaatgtcacagtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgaccttatcttatatacaaactaactttacatctctcaatggtgagccgataccatctcttgatgatgtactaaatcattttggaacaaaagttaaatattatatagaaactaaacgtccgtttgatgctaatatggatagagaattattaactcaattaaaagcaaaaggattaataggaataggttcagagagattccaagtaattattcaatcatttgctagagaatctttaattaatattcataatcaattctctaatatacctttagcttacctaacaagtacattttctgaaagtgaaatggatgattgtttaagttatggtttttatgctattgcgcctaaatatacaactataactaaagaattagtagatttagctcatagtaaagggcttaaagtccatgcatggacggtaaacacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccctgagaactacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaacaacagaagagtttggtaacgttaaacctaatgcttctcaaagagtagatgagggtataaaagaattagataaaaatgctcgtaaaacgagagatagaaacaatcaagaaatatctagaagagaaaatacaatacctaaatctacaggagataatacgaacgagggtaatagacttaagcaaagcttccctagtagttctatatataatcctagacaatctactaacggattaaaaggtaatattgacaatatggcgctgataataggttacggtgatggaggtgtatctagctaatgaataattttataccacaacctcaaggtctacttagatttttaaataccctagatacagatttaacttcttctcatatgaatttactggatgaagaggtatcatttgtatctaaattttatacaccacagctacaattaagtgaattagcaaaaaaagtattgacaaatataaagacagatgatatacctgtattagaaagagaatttaatgataatacaattatccataaagctaacgatacattactaaaagtacaggctccaagaatgtatatgattctacagtcgattgtacttgaagcatatgctattgttaattgctttgtagaaaatccgagctctttaaaatacttaactgaagaagatgttagtataacacgggaaaatttaaattatgtagctgactacttaggtaactatgatgactataatagtgttgtcttagacttaagagatttagacttatgttttagtgctatagaattacaattacctctaatcaaaaaggaggctaacgtataatgagatttaagaagcacgtagttcaacatgaagaaacgatgcaagcaatagcacagagatactatggtgatgtgagttattggatagacctagtagagcataataatttaaagtacccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttctttaatgctacatcctaattacggttcagatttgcataatttatttggtcttaatatacctgaacaagctacattaatagaaatggaagtattgagaacattaacatcagataatagagtaaaatctgctaatctaattgattggaaaattcaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttctcgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacccgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcactgcagatacctgatgtagaaggtgtttatgtttatgaagaaacaggacatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgatgtattaatatatgatgtgtcatttgataacctagatgagaacattatagtaccgccacaaggaattattagagcaggagaaataaaagtagaactaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagtaagttacaatcttctctaaagacatctaccagtgaatatttagataagtttggggattggttcggagtttatcgtaagaccgatgagaaagatgatgtttatagagcaagaattataaaatatttactcttgaaaagaggaactaataatgctataatagatgctataaaagattatttaggtagagatgatattgatgtaagtgtatatgaaccttttacaaatattttctatactaacaaatcacatttaaatggtgaagaccacttaatgggatactattatagatttgctgttattaatgtctctataggtgattatttccctgtagagattatagatgtaattaatgaattcaaacctgcaggtgtaactctatatgtcacttatgatggggcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaaccatagcttaattaatagtttagatgttttaacaggttcatctagtgtagggagacagtatattaactacggatatgtaacatcatatgtttataatccaggtatgacatcttctgtaaatcaaataagcgctagtacagaaggtagaggtcaagaagtacctactgactattatatgtatactagtactaagaataacaatacagtagaacttagtatgcaaactacttccggtgtgtcttatttatataataactttaattttagggactatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataatttatctttctatgaaaaaaatatcgggagcaatataggatatataaaagattatctaaacagtgaattaaatatgtttactaggttagagataaatgcaggtaaaagagattcagtagatattaaagttaattacttagatttaatgttttattactatgaacgaggtatttatacaataaaaccgtataaagcattaatagaaaattatttagatatatctagagagacttatgtagaagcatttaaaatagcatcattatctaatggagatattataactaaaacaggttttcagcctatagggtatttaaaactagttggtaattatgaaaatacaatacctagcacaataaatatagtagctaaagatacagataataaccctatagaatctaatgaattagatgtatataatacagtagagaatagaaatttattacaatcttataaaggtgtaaatacgatagctagagaaataacttctacaaaagagtttactgtatcaggatgggctaaagagatatactcaactaattatctttctaaagtattaaaaccaggtaaagtgtatacgttatcttttgatatggaaataacaggtaatgacccaactcttaaatcttattctgataatcatggtatatatttatacagtaatactaagggaattgttgttaatggtgttaaatctatggaacgtactataggtaacaaagtatccgtaactcaaacttttacagcccctactattactgaccatagattactaatatatactggaagatatacatctgatggtaaagcatcaactcctccagtgttctttaatacagttaaaattacggaattaaaattgactgagggttcttctaagctagagtactcacctgctccggaagataaacctaacgtaatagaaaaaggaattaaatttaataatatcctaactaatatacagactttaagtattaattcggatactatcttaaaaaatgtaactttatattattcttactatggtgatagttgggtagaactaaagactctaggaaatattagtactggagaaacaacagaaaccaataacttaatagatttatatggattacagacagtagattattctaatataaatccaatgtctaaagtatcattacgttccatttggaatgttaagctaggtgaattgaacaatcaagaaggttctttatctaatatgcctaatgattactttaatgctgtatggcaggatatagataaattatcagatattgagctaggttctatgagaatggttaaagacactgagggcggagtattcgatggagctacaggtgaaattattaaggctactctatttaatgtcggtgcttatactgatttagatatgttagcctatactttgactaattatactgaaccgttaacgttaggctctagtcgattaataagtgagctaaaagaagaactactaacatcagaatcatttaatgtcgataatagaattaaagtaattgactcaatatatgaggagttaccaaatacaagcattattaaaaatggatttgttgaaagagaagttacaggttctaaatatttagattacggtttatatgagcctatagaagatggtactagatataaacttattgtcgaaggagaatttaaagataatatagaatttatatctttatacaattctaaccctaactttaatgaaacatttatatatccatcagagataattaatggagttgctgaaaaagaatttattgcaaaaccatctactgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacgtacagacaggtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaaggaggatgattatttatggtattcacattagaggatttcgtgggagattggcgacagacggcaggttataacttagaccaggttttagagcaaggtggtgtatcttctttgtttcagaacttgggagtcagtgttacacctattcagcgtatagtcttgagtggtgagaacggattaaagattgatatccatgtcattattccttacgaaggattgtcaggagatcaaatgggacagatcgaaaagattttcaaggtagtgtacccagtcgatgaccaccacttcaaggtaatattgcactatggtacattggtaatcgacggagtaacacctaacatgatagactatttcggaagaccttacgagggtatcgcggtcttcgatggtaagaagattactgtcacgggaactttgtggaacggcaacaaaatcatagacgagagattaataaaccctgacggaagtttgttgtttcgagtgacaataaacggagtgactggttggagattgtgcgaacgtatattagcttaataaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggtgatgcaatattcaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcaggttcatataaagtaaatggttttgaactattttcagaaggtaatgctgaagatgatgaccacgtttctgtagttgtagatgcaggtaaagcctatgtaaaaggttttaaagtagacaaacccgtatcaacaagaattagtgtacctaaatcttatgacttaggaacagcagaaaatgaaagtactatctttaataagtctaataactctattagtttagctaatagccctgtaaaagaaattagacgtgttacaggtcaagtacttattgaaaaagaacgagttacaagaggagctcaaggtgatggtcaagattttctttcaaataatacagcatttgaaattgtaaaagtttggactgaaacaagccctggagttactacaaaagagtataaacaaggagaagacttcagattaacagatggtcaaacaattgattggtcacctcaaggtcaagaaccttcaggaggtacttcatactacgtttcttataaatataacaaacgtatggaagccggtaaggattatgaagtaacaactcaaggtgaagggttaagtaagaaatggtacattaactttacaccttcaaatggtgctaaacctattgaccaaacagtagtattagtagactatacttactacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgctctagatgatggtgctatggaaggacagaaccctctaacattacgttcagtattcagtgaaggtttcattagtcttgacaaagcagacattacacatcctgacttcggaattgtatttagttttgaagatgcagaagctactctagcttatacagaagcagttaaccaacctaagattattccaggagatacaacagctcatatttggggtagattaatttcagcaccatttactgaggaacgtacaatctaccaaggtcaagcatcagaaacattaaatgttaacccttataatattcctaacaaacaaggtgtgttaaaattaacacctagtgaggataactggattgatactgaaaatgttacaatcactgaacaaaaaactaaaaaagtaactatgaaacgattttggagacataatgaaagttactatggtgagactgagcattacttgtattctaacttacagttagatgcaggacaaaagtggaaaggtgaaacttacgcttatgatagagagcatggtcgtaccggtactttattggaatcaggaggacaacgtactctagaagaaatgattgaattcattagaatcagagatgtatccttcgaagttaaaggactaaaccctaatgataataatttatatttattatttgatggagtaagatgtgctataacacctgcaactggctatagaaaaggctctgaagatggtacgataatgacagatgctaaaggaacagctaaaggtaagtttactattcctgcaggtattcgttgtggtaaccgagaagttacacttaagaatgctaactctacaagtgctacaacttacacagcccaaggacgtaaaaaaaccgctcaagatattattatcagaactcgtgtaacagtaaacttagtagacccgttagcacaatcattccaatatgatgagaatagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggagtacgctattgttattattactgagaacagtgattatacaatgtgggtaggtactagaactaagcctaaaattgataaacctaatgaggttatttcaggtaatccatacctacaaggtgtattattcagttcatcaaacgcatcaacatggactcctcaccaaaactctgaccttaaatttggtatttatacttctaaatttaatgagacagcaacgattgaattcgaaccaattaaagatgtatcagcggatagaatagttcttatgtctacgtacttaactcctgagagaacaggatgtacgtgggaaatgaaattaattctagatgatatggcatcttctacaacattcgaccaattgaaatgggagcctatcggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacagatatcacaacccgactttaataatattttagcatctatacctgatagtggtaactattatgtaactaattcaaaaggtgctcctagtggagaagctacagcaggatttgtaagattggataaaagaaatgtaaattattataaaatttactattcaccatatagcagtaacaaaatgtatatcaagacttatgctaatggtactgtatatgattggattagttttaaattagatgaaggtagcttatacaatgaaggtaatactttgaatgtaaaggaacttactgaatccacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctgatacgtacccttcagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacattcactatacctgaaaatacaatcggagcatcaggcgttaaagttaattacgtatctttactactaagaatgaattgttcatctagtaaaggtaatggtgctgtagtatactatgccttacctaaattagaaaaatcatctaaagttacaccatttattacacatgaaaatgatgttcgtaaatatgatgagatttggtctaattggcaagaagttattagtaaagatgaattaaaaggtcactcccctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccatatagagctaataagtttgttaaattattgtttactgacacagagggtattccttacacattatattatggtggttataaccagggttggaaacccttaaagcaatcagaaacttctactttactatggaaaggtactttagattttgggtctacggaagctgttaacttaaatgactcattagataattacgatttaattgaggtaacttattggactcgttcagcaggacatttttctacaaaaagattagatataaaaaatacatcaaatttactgtatattagagattttaatatttcaaatgatagtacaggttctagtgtagacttttttgaagggtattgcacttttcctactagaacatcagtacaacctggtatggtaaaatctataactttagacgggtctacaaatacaacaaaagtagcatcatggaatgaaaaggaacgtataaaggtatacaatattatgggaattaatagaggataaagaaaggtggaataaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatatttgtattatagtaaacctgaagaggttatagaaaataaaaactatgtaccaccacaaatcaatgatgatgatgaggaatcccaacaaattactgtacctaaagaacaatatgatagtttaaaagaagaactagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattacctagtaataaaaatgctgttatatcaggaactaatattttagatatagcttcaccaggtgtttactttgttatgggaatgacaggaggaatgcctagtggagtaagctccggatttttagacttaagtgtagatgctaatgataatagattagctagactaactgatgctgaaaccggtaaagaatatactagcattaagaaacctacaggaacatacacagcctggaaaaaagaatttgagccaaaagatatggagaaatatctactaagtagtattagagacgatggtagtgcatcattcccactcctagtttatactagtgatagtaaaacatttcaacaagctattatagaccatatagatagaacaggtcaaacaacctttactttctatgttcaaggcggtgtatccggttcccctatgtcgaatagttgtcgagggttattcatgtcagacacacctaatacttctagtttacatggtgtttacaatgctataggtacagatggtagaaatgtaacaggttcagtggtaggtagtaattggacttcaccaaaaacatccccttctcataaagaattatggacaggagcacaatcattcttatctacaggaactactaagaatttatcagatgatattagtaactactcttatgtagaagtttatactacacataagacaacagagaagactaaaggtaatgacaatacaggaactatatgtcataagttttatttagatggtagtggaacttacgtttgttcaggtacatttgtttccggggatagaaccgatacaaaaccccctatcacggagttttatagagtaggtgtatcttttaaaggttctacatggactcttgtagatagtgcagtacaaaatagtaaaactcaatacgttacaagaattataggtattaatatgccatagactaggagaaatttcctagtctttttttttcttgacttgaaaaggattctgtggtatactataactcgtgtaaggatataaggagattaaaatgagattaagaattaagaacttatatacctatgtagaatttgaggaggatgataaatacttaaaagatatatttttaaagagagtccatacgactataggagcaagacaagaaggatttcagtacagccctgcgtacaaaagaggtagttgggatggttatgtagatttttatgtttatgaggaagataaattccccactggacttttatttaaaattgagttattattaggtgagctacaatcaaggtataatttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaattattacctcaattagaaaaaggtgagagagtagcattcttcacaggctctacggagatattccatcagtctgcagataggctccaagagcgtttaaatattcctattggtaaagtaggtgcaggtaagtttgatgttaagcaggttacagttgtaatgatacctactttaaatgcaaaccttaaagacccaacacaaggggtaaaggttacgcctaaacaaaatattagtaaaaagattgctcaagagatattacctaaatttgaaggtggaacaaatcaaaagaaattactaaaagtattacttgataacacaacacctaaaacaaaagtagaacaaaatgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtacaataatttaatgacatgtgaaaaagctttatatcgaattgcattaacagggtctatagataaaaaagatgaattactttggatgagattgcaggcgctattcggtaatgttattgcacgaactactaataagtttttaattgatgaaggtcattctgctagaccaacaataaatattatacctgtagctaatcctaatgacatagatagaattgatgattatagggaagcttacgataaaggtataacaaataatgattttaggaataaacttattgcaaaactaacagaaaagtggtataatcaagataaaggtacattgattattgtaaacttcattgaacatggagacacaatatcagaaatgttaaatgatttagatgtagagcattacttcttacatggagaaatagactctgaaactaggagagaaaaattaaacgatatgagaagtggtaagcttaaagtaatgatagctacatcacttattgatgagggtgtagatatatcaggtattaatgcactaatattaggtgcaggaggtaagtcattaagacaaacattgcaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggggtaataataactttagttagagagtatgacacagaagaattgaaagaattcaataattctacagataatattattacttccgatttacagtatgctaaggcattaagagaaaagcacttcccttcttatagatatgagagaaaagaacaacgtagacgtactaagatagaaatggcacaatacaatgccattaaggatgagaagagaagaattatagcagatatgaatttctattcagaaggtcttccttatccttctaaagatatttttaatatgtcctatgacccggaagggttttataaagcgtacatcttatgtaagttatacgaccaatatgctatttctcatatggatgctaaacatacaagtcatcttaaagcaatgagtaaggcaacaactaaagatgaatacgactaccatcaacatatgtctgaatactatagaaataaaatgattcaaaatttacctagaaatagcgttagtgataatttctttggtagtaaaatgtttaatactttttataatttttatttaaaaataaaagataaaaatattaatgtatttaagtatatgcaaaatgtatttaaaaatgtaacattttattacgagaacggtatgcaacctaatccaataccttctcctaacttctttagctcagataagtattttaaaaactataataattatattaaaggaataaaaaaaggtgttaacagtactaatagacacctaggtgatacagacagcatcattaattcatcagactatgtgaaaaaccctgctgtattacatctacaccaactatatactacaggattaaattctactttacatgatattgatactatgtttgaacaagccttagaccttgaaaatgcctcctatggattatttggagatatgaaacatattattttactacagtataattctatgattgaagaagaaattaagaatttacctagagaagaaaaggatattattaataaatatgtaaaacaatgcataattaatgattattcaccaacaagtatttcaccttctgcaaggttatcaatgtttactatgcagaaagagcatatagtttacaataagcagttaaataaaggaatcaagagagaggatttattaccattaagtctaggaggtatagtgaataaagatttattgagtggtatggatatacaaaacttagaacagaatggtaatgaatacctatatatgagacaacatacttcaacttattatatattaagaatgtttggtgactatttagggtatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagaacaaattattgtcaatacaacaattaagaaggataaaaatattgatgttgttattattgactatcctcacttaatgagaaatccttatgctaaatatcattcagaatcagatgcaggagggaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagcggtttcttaagattgtatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatataccacttgacattttatatgttaggtggtataattattttataaagaataaaggagagattaataatgaaatttgtattctttacagatagccactttcacttatttactaactatgctaaacctgatgagcagtatgtgaatgatagatttagagaacagatacaagctttacagaaaatgtttgatattgcaagagaagaggatgcaacagttatatttggtggggatttattccacaaacgtaacgcagtagatactagagtatataataaggtatttgaaacattccaacttaatagagatatagaagtactaatgttaagaggtaatcatgattcagttacaaatagtttatatacagattctagtatagaacctttcggttacttacctaatgtagaggtttgtaaaaaccttgatactttagggtttttaggagaagaacaggatattaatattgttatggctccttatggagacgagactgaagaaattaaagagtttattaaaaataaatatgtagaagatagagtaaatatcttagtaggtcatttaggtgtagaaggctctttgactggaaaagggtctcatagattagaaggggcatttggataccaggatttattacctgataaatatgatttcattttactaggtcattatcaccgtagacaatatttccaaaatccgaatcatttttatggtggttcattaatgcaacaatcattttctgatgagcaagaagctaatggtgttcatttaatagatacagaaaaaatgactacagaattcatcccaatccatacacgtagatttattactattcaaggagaagatattcctgagaactttgaacagctaatcgaggaagataattttattagggttatcggtacagcaaatcatgctaaggttttagaaatggatgacagtatgaaagataagaatgttgaagttcaaattaaaaaagagtatactgtagagaaacgtattgatagtgatgtgtctgatgaccctttaacaattgctagtacctatgctaaacaatactcacctgaatcagaacaagaaatacttgagtgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtagtaagtaaagacttagataaaagtaaacctattttacaattccaagattcagatggagtaatagagaatatttgtaatgttgaaggtttagaagatggtctaagtaaaatgaaaaagatttttgatgatagtaattttgaaaagcattattacaatagagtagtagaccatgatgagtattactggattgattatggctctcatcattgtttctttagagttacgaaaggggataagtaatggttgtatttaaacaagtagaagttaataattttttagcaattaaagaagctacgctagagttagacaatagaggattaattctaattgaaggtgagaataaatctaatgagtcatttcattcaaacggctcaggaaaatcaactttaatatctgccattacttacgctttatatggtaaaactgaaaaaggactaaaagcagatgatgtagtaaataatattgagaagaaaaatacatctgttaaacttaagtttgatattggggaagatagttatttaattgaacgttatcgtaaagataaagagaataagaataaagtaaaattattcgttaatgaaaaagagattacaggttcaacaaatgacgttaccgataaacaaatacaagatttatttggtattgagtttaatacttacgttaatgccatcatgtatggtcaaggagatatccctatgttctctcaagcaacagataaaggtaagaaagaaattcttgaatctattactaagacagacgtatataaacaagcacaagatgtagcaaaagagaaagttaaagaagtggaagaacaacaaaataacataagacaggaaatctataaactaggttatcagttatcgacaaaagatgagtactttcaaagagaaatagagcagtacaatcaatataaagaacaattggttcagatagaaaacagtaataaggaaaaagatagattaagagaacaagaggagaagcaaatagaagctcaaatagagcaactagcttcacagataccaacaatacctgaagatgaatttaagcactcagaggagtataataaagcctctcaaagcctagatttactttctaataaattaacggagttaaatcaagtttactcagagtataataccaaagaacaagtactaaaatctgaaatagctacattaagcaatagtctaaatcagttagatacaaatgaccattgtcctgtttgtggctcccctatagataattctcataaattaaaagaacaggaaaatatcaataatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagcataattcaagaggcttctaggattaaatcagacattagttcattagagaataataaaacgtatttaaaagttaaatatcaacatcaatctgttcaaggattagagagagaagaaccaagtaaagaaaaacatgaggaagataagaaagaattacaagaatctattgacaaacatgaagagaatatagtacaattagaaactaagaaaggtaaatatcagcaagctgtagatgcttttagtaataaaggtatacgttcagtagtgttagactttattacaccattcttaaatgaaaaagcaaatgagtaccttcaaactttatcaggttcagatattgaaatagagttccaaactcaagtgaagaatgctaaaggagaactaaaagataagtttgatgttattgttaagaatagcaagggcggaggttcgtacaaatccaattcagcaggagaacaaaaacgtattgatttagcaattagttttgcaattcaggatttaattatgagtaaagatgagatatctacgaatattgcactttacgatgagtgttttgatggattagatactatcggttgtgaaaacgtgattaaattattaaaagatagacttaatacagtaggaacaatatttgtaattactcataataccgagcttaaaccactgtttgaacaaacaattaaaatcgtaaaagaaaatggagtatcaaaactggaggaaaaataatgaaattaaagattttagataaagataatgcaacacttaatgtgtttcatcgtaataaggagcacaaaacaatagataatgtaccaactgctaacttagttgattggtaccctctaagtaatgcttatgagtacaagttaagtagaaacggggaatacttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctattataacagaagaatatgatgctaatactgtagagcaaggatttagagatattggagttatattccaaagtcttaaaactattgttgttactagatacctagaaggtaaaacagaagaagaattaagaatatttaacatgaaatcagaagagtcacaactgaatgaagcacttaaagagagtgatttttctgtagatttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaaccctattacatttatgaagacttattataacattacaggtaaacaagcttttgatttattagagtctaagaatatagatatagagagagcccctttacttacgaccaataataaggatttgacagaatcagagaaacttatattaatgcttagaggtgtgcaccaagataaaggaaatactagtattaaacctcctagattacctgaagggtataaattattaaaagataacttaaataataaagagattataccctttttaaaatacttaaaaggtagaggtataactttagaacaaatcattaataacaatataggttatgttattaatgggagcttttataaagttgacggggaatccaaagtatcattaaggaatagtattatattttttacttatgataatgatggaaactaccagtactggaatacaagaagtatagagaagaacccttatattaaatctattaatgctcctgctaaacaagatgaagtagggagaaaagatgtcatatttaatttgaatatagcaagaaagaaaaagttcttagttataactgagggtgtatttgatgctttaaccttccatgagtatggagtagcaacattaggtaaacaagtaaccgagaatcaaataaaaaaaataattgattatgttagtatagatacatcaatatatattatgttagacactgatgcactagataataatatagacttagcttataagttaaaaacacattttaataaagtttactttgtacctcatggtgatgaagatgcaaatgatatggggacaaggaaagcctttgagttattaaaacagaaccgggtgttagtaacacctgaaagtatacagagttacaaaatacaacaaaaacttaaactttaggcttgaccttagagaagttttatgttatactagtaattaagtaattaataaaggagaaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgagcagatgacagacttagaatataataatgagttaaacttaaatattttaattgacgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgcagtacaaggaactgttgatggtaaacaagttgatgagaaaacagctaaacaattagatagaattggttcacgtagtgtttctttagaagaagcaactcgtattgctaaagttcttaatgctgtaacagctcaagaggttacaggagactttaatgatgcatttaatgcaattgacttaatgatgattatcatggaagatgagttaggagtaactcaagaaaaagtagggaaagctaaagataaactaaatgaaaaacgagaagcttacctaaaagagaaacaagaagaattacgtcaaaaacaacaagaagaggcacagaaaaaaactgaatctgacagcaatgaaaaagtaattcagttgaagaaaaatgacgaacagtaagaaaaaaggggatacattcgaacgtaaaatagctaaagaattaacttcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataatgttcttctaaacaacagagagccacatacatggtgggagcaagtcattaatgatagtagcaaggtgaataagacaccttgcttaatatttactagaaatagagctcagagttatgttgctttaccttatgatgaaaaagtatatgaagatttaagaaataatgaataccctgtcatgagaacagattttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagtaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggtacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaacgttcctgacactattattgatgaaatgactaagttagcttacagttttaattttaaattccctagtttcatggcagggcaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataacaactcaggacaagctaatagaggtgaactaagctcatgttatctatttgtagtagatgattcaattgagtctttaaactttgttgaagatagtgtagctaatgctagttctaatggtggtggagttgcaattgatttaactagaattagacctaaaggagctccagtacgtaatagacctaattcaagtaaaggtgttattgcttttgctaaagctattgaacataaagttagtatttatgaccagggtggtgtaagacagggtagtggtgctgtttacctaaatatattccacaatgatatcttggatttattaagctctaagaaaatcaatgccagtgagtctgttagactagataaattatctattggtgttacaatccctaacaaatttatggagttagttaaagaaggtaaacctttctatacttttgatacttacgacattaataaaatgtacggtaagtatttagatgagctaaacattgatgaatggtatgataagttactaaataatgatagtatcggtaaagtaaaacatgatgctagagaagttatgacagacattgctaaaacacaattagaatcagggtacccttatgtattctatattgataatgctaatgataatcacccattgaaaaacctaggtaaagttaaaatgagtaacttatgtacagaaatttcacaattacaagaggtatcagaaatttatccgtattcttacagtaatcagaatgttattaatagagatgttgtttgcacattaggttctcttaacttggttaatgtagttgaaaaaggtttattgaatgaatctgtagatattggtacaagagcattaacaaaagttactgatattatggatttaccttacttacctagtgttcaaaaagcaaatgatgatattagagctatcggtttaggttcaatgaatttacatggacttttagctaagaatatgattagttatggttctagagaagcattagacctagtaaacagtttatatagtgctattaacttccaatctattaagacatctatgttaatggctaaagaaacaggaaaaccatttaaaggctttgagaagtccgattacgctacaggtgaatactttgtaagatacattagagaatccaatcaacctaagacagataaagctaagaaagtcttagataaggtttatattccaacacaagatgattgggatgaattagctaaagcagtgaaagtacatggtttgtataatggttaccgaaaagcagaagcacctactcaatctatatcttatgtacagaatgctacaagttctattatgccagtacctagtgctatagagaatagacaatatggagatatggagacatattacccaatgccttacctaagtcctataactcagttcttctacgaaggagaaacagcttataagattgacaataaacgtattattaatacaagcgcagttgttcagaaacatacagaccaagcagtgtctacaatactttatgtagagtcagaaatacctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatctcccaattttggactcctgaagagtttgatgtatcaagagatttaagttcttggaatagtttaactgaaagtgaaaagaacacttataagaaagtccttgcagggctcacagggctcgatacaaagcaaggaggagaaggtatgaacttagtatcctaccacgaaccaagacctaaataccaagctgtatttgcgtttatgggtggtatggaagagatacatgctaaatcgtatagtcatatctttacaacattactaagtaataaagaaacaagttatttattagatacttgggtagaagaaaacgactttttaaaagtaaaagctcagtttatcggatattactacgaccaactattaaaacctaatcctactatatttgatagatacatggctaaagtagctagtgcctttttagaaagtgcattattctactcaggattttattatcctttacttcttgcaggaagaggtcagatgacacaatcaggagctattatttataaaattactcaagatgaagcttaccatggttcggcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagatattaaagatgaagatttctcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaggatgctaaagctgatgatacgtctaattcttttcagctagagtttatgcatgatatgaccatgtatactttatcttatggctcaggacagctaaaacttattgatttagcagaaggttatgaagcacaaaaagctacaatagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtaacacacggtaatgaagaagaaattgaaaagaatatggatgaattaatatctaagtctagaagatatatcatgagggatgaaaagcattacatgctatttaatgagaagtacaataatgataggcttatagaaaaagtatgtaaacacggtggtaaagttacatactatactgattcagtattaccttactatgttttaaaagacttatctagtcaccctgactcagaagttgtttatcgtatgcgcaacggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattaggggtagatgaaaaacaagaaaagttttatttctttgatggtgaagcttatgatttaaaacccgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttgctagaagaagggtatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaacggaaaaacacttaagaaattacttgagaagtgttctaacttaaagagagataaaacaaacagagattatgatattgattttctctacaatgcagtacctacacctattagaaatgactacggtaaaatcattaaataccaagatgttaaacaagcagaagtaaagccatactatgagagaatgaataatattattattgataattcttatgatatggtaattcctgtaggtaaactaggtgttaaatacctattaaatgttacagctattggtaaagtaagaggtgtaccaagtaaagtaactattgaaaatggaacatcttctcatgatgtgtgggtattacctacttatagcattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggggtagatattaccgcatgggacttagagactaactcattaaaacctgataaagaaggaagtaaacctttagtactatctctatcatggagaaatggtcaaggtgtaactatacccttatacaaatcagactttaactgggaaaacggtcaagatgatattgatgaagtcttagaattgcttaagaattggttagctagtaaagaagatattaaagtagcacataacggtaaatgatttgctgttgtaaaatccctctcatatcgggcatagctttaagtagctgataagagaacctaagtcctgtaataaggatagtggtaatcccgagcttacattattggtgacaatagatggggtgtagagactgagccgaggttttgtagaccaaggtgagacatagtgtatcgacttaatagaggtggtacagtgaaaaaagattatatgacatcagttaaaaataacaaaaaagtatgtagaagatgcaacgaagaattagatttatctaactttaaaacatataagaagaatgataaaacttattatcaaagtatgtgtataccttgtcggaaggaatataataagttagataaaactaaaaatactattaaaaaatgttatgagaaaaacggagataaatatagaagacaaagtaatgagtataatacttctgacagaggtagagagcttaataaaaataggtctaggaaatacagagaaaacaattctttaaaatcgaaagctagaagctctgtaagaaccgcattaagaaatggttctctcataagacctgataagtgttcagagtgtaataaagattgcatacctgaagctcaccatcctgattatactaaacctttagaaataaaatggttatgtaaatcctgtcatgaagatactcatcataaaaaataatcacactatgtaaatgagggacatcaagcccatttaggtaactacaaacaaacctaatggtaagggcttatgaaggtatagtccgttctatatagaaatatataggctaaaacgaaatatgatattaagttcttaatgagtactgaaaactttaaagattttgagagtattcaggatactaaagtaggttggtacctagctgttacccaagaagttaaagaatctttaagattatctgatttagcttatgaggttacagatgtcggaggctatgataaaccattagaagactttaaattatggtttgttactaagttattaagattcttctcagataaaattaaagagatacagaaagaaaataaaaagattgctaagaaagagtatgatgttaaagctcctgaatataaagaatggttagagaataaattaaatgaaacagtagtagaactagatgatactgagaaaaaatttagagttagtgaattagagaaaaagtatattcaactaggtctttcacctgaaattgtaaatatgaatttagttatggataatgatgaattcataaatattgcagaacaatcacctgagtacatggggttatctgactacgctaagtcttacacgttaaatactgcaattaatttaattaatgagtatagagatgtaaaagatgtagttaatgatattgacggaggtaactttaattatgattggttccctattgagttaatgcatccatacgcatcaggagatactgatgtatgtagaagaattcattgtgatgtaattaagaaacttaaagaacaagatagacctaagtcaatgcatttattagaagttaattacccaagacttactaagtctttagctagaattgaatcaaatggtttatattgtgacttagattatatgaaagaaaatgatgagtcatacgagtctgagatggctaagaaccatgctacaatgagagagcactgggctgttaaagaatttgaagaataccaatacaatctttaccaaatggcgttagaagaacatgagaaaaagccaaaagatagagataaagatatccatcagtacagagataaatttaaagatggtaaatggatgttttccccaagttccggagaccataaaggtagagtaatttatgatattctaggaattcaattaccttatgataaagaatatgtcaaggaaaaaccatttaatgctaatgttaaagaagcagaccttacttggcaggactataaaacagacaagaaagctattggttatgcgttagataatttagaattaaaagatgatgttaaagagcttcttgaattacttaaatatcatgctagtatgcagacaaaacgtaattcatttactaagaaattacttaatatgattaataaacaaaaacgaacattacatggttctttttctgagacaggcacagagacatcaagactaagtagtagtaacccttaaattggggttgtaaaactttgttaactgcgggaagagactcgttaggtcttaactactaacttataatggaaacatatataagggcaaacagtaacgtgtttgatatagtaaaaaggttaagaatagagagaatccgcatccaagaccctgaaagtatataaaagtatgggtaaggttcaacgactaggtgttgagacaatacaatcaatacacacccacgaaagcaaaggtattatttctgtggtagggaataataaggagagttatatgaaagagatttggaagaaagtagtaggatttgaaaactacgaggtaagtaataaaggaaaagtaaggaatataaaaactaactatattttaaagccgtggataataaattccggatatgagcaagtatctataggtattgctaatgtattagtacatagattagtggctatgacatttatacctaccgacagctatagtatagttaaccatattgataataataaattaaataactgtgttgaaaatttagaatgggtaagttacaaaggtaatagtgctcacgctaataagcaaggaagattgaatacttatagtgcaagagaaaaacttagttctgtatctaagaaagccatttatcaaaaagatatggaaggtaacatcattaagttatgggattcaccaagtgaagctgaaaaagaatctaatgggtactttaaaagtactaagattagttccgttgctcacggtaaacgtaagcatcatagaagttatacttgggaatacgtatataaggattcaaagagaagtttaaataagtctattaatatgtatgatttaaataataatttattatatgaagatttgacaatgaataaaattatgggtatactagaaatgaataatcataaaacattaagagataaactaagaaatacagatgactttgttgaatacagaggatataaatttaaaaataataattaaaacctaccacagaaatgatatatgatatagtctactcaatagtgagagctattgtgttacctaaacagtaacagattgtaaactaaaaagcttacaaattatagaatttacaaaacttacctgcacacacatcagatgtaaataagtttgattacaaacatccaattaaacgttcatttgtttctagatttgaaaatggagtactgctagggtccgactatagcgccctagagatgcgtattatcggattatttactaaagaccctgatatgctacaatcattcttaaatggggaagatatccataaggctactgcaagtattgtttacaataaaccagtagaagaagtaactaaagaagaacgacaagcaactaaagcagttaacttcggattagcctttggtgaatcacccttctcatttgcaggtaaaaataatatggaagtaagtgaagcagaagaaatatttgaaaagtatttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactatcatccaaggttcaggtagtttcttaacaaacatgtctttaacttacttagatgattttattcaatctcgtaatttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagccgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttatcaagaaatttaataaaagtattgacaatatagttaacttatgttatactatataagtaataaatataaggaggaaaaagagtgaatacaggggagattagatttaatcgttctatggatgaatggattataacaagcatgtaccaggatgagctaggtgggatgaatattgttgttacattctataatagagaagaaaataaacatggttctacagttttaccaacagagtcatctactggagaagtaacagaggaattggcaagtcttgaagaagaatatcctttagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggattttatgcaacaatcagctaaatatgctttttgggcttctatattagagaaggtaagagcatattctgaaatggaacaaagaaacctagaaacaattggtagtaagctaaaccttacaattagacaagagtacgaacaacaaggtaaaaagcctactaaagatatgattgaatctagtgtttatattcacgattcttatcaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcagggattcacagggttaacattacctgcagaagagggttcatctgtccttgacccatacattcaggattggataacaaatggtgttcagttcagtagattccctaataaaccaggagtacgctattacattcatgttattgaatactttaataacaatggtcaaattcaaccaaaaacggatgctcaaggaaatgtaatgattcaacctatggaattatctaatacaggatataaagaattattagctaacttaaaagacactatgttaaaaccatcacctaatgcacctcatagctttatctcagcaactgaagcattcctagttaatattgttaaagctaagaaaggtgaaatgtcatggaaagtaagtgtttatcctaatgcccctttaggtgcgttacctcaaggttgggaacaacaattatctgacttagaccaattagcaaaaccaacagaagaacaaaatcctaattttgttaacttcttaatcaataacgttaataacacagagttaagtcatgataactttaaatttaaccgtgaaacaaatgtcttaggtgaagaaccttcagagcctaaacaagcacccacacaacaagatgtagatagtcaaatgccaagtaatatgggaggacaacctaatcagcctcagcaaggtcaagtaggtcagtatgcacaacaaggtcaaagtaatggtcaaggacagcagttacaaggtacacaacaacctatcaataacactcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaacaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtcgatttaacagatttaaatacaattgatttaggtaaagaattaggattaacattgctatcagatacaaacagagcagatattaaaaacgttatacctacaatggttcctcagtatgactatattttaggtggaggtattccattaggtcggttaacagaagtttacggtttaactggcagtggtaaatctacttttgcagttcacttatctcgaattgcaacacaattaggtgttatcactatttggattgatattgaaggaacagcagataacaatcgtatggagcaacttggtgtagatgtttcaaaactattctctattcaatcaggagaaggtagacttaaaaatacagtagaattatctgtagagcaagtaggtaaagaattagagtactggattgacactttcaatgaaaagattccgggagtacctattgtatttatttgggactcattaggggctacaagaactcagaaagagattgatggcggtattgatgagaagcaaatgggtcttaaggcatcagctacccaaaaagtaattaatgcagtaacacctaaactaaatgatacaaacacagggttaattgttattaaccaagcccgtgatgatatgaatgcaggtatgtatggtgaccctattaaatctacaggtggtagagcttttgaacatagtgctagtttacgtattaaggttcataaagcatctcagttaaaacagaaaagtgagttaactggtaaagatgaataccatggtcacattatgcgtattgaaactaagaaatctaaactatcacgaccagggcaaaaagctgaagcagacttactatctgattatatggtaggtaaagaagatgaccctatcttattaaatggtatcgacttagaacatactgtatataaagaagcagttgaaagaggtttaattaccaaaggagcatggagaaactatgttacattgaatggtgaagaaattaaacttagagatgctgaatgggttcctgtacttaaagataataaagagttatatctagaattgtttagtagagtttatggagaacacttccctaatggttactcaccattacttaataacaaagtaatcgtaactcaattagaagagtatcaagctcttgaaaactactataaagaatgggctacagataataaacaagaggaacaagaggaagaactaaaaggagaatctcaagaaaaggattctgaataatagatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaagaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagggatttagatagtttacttaataggtataaaaaccttagatggtcgttatatcataggtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtctttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatacggattaccctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgcaggaacagctaatgttactgtaactactgaagatggtagtcacactgatattgttgctgtaacagttaaggaacctattcctgaagcacctgcagacgtaacagttgaacctggtgaaaatagcgcagatattactgtataggaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgattatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaatcaagattaaatcattttattaatacaacagttaaagaaattgaagatagggaaatttctaatgtaactgtttactttgttggggacttagtagaacatattaatatgagagatgttaaccaagcatttgaaacagagtttactttagcagaacaaatctctaaaggtactcgattacttattgatatcctaaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaagggctattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtgaaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatcttcaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtacaaacataatcatgtaggtataatgagttacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgctagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggggtaagagtaattaatgagcaaagacaaaccaaatagacgtaaagagatacagcatcaacctgttaactttgcccctacgaatactttaacaggagctaataatagtttctttgctaaaaagccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaagggtaaacatttgatatttatattcaaaacaagacatagagttaaagcagaaaggaaagataaataatgttaaaaggattttcagaacatgtagacaaacctacaactattaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttaagaaataaaaacagtgatataaaagttgttcctgataaagaaaaagaaagtatattatctaagttataccataataagttactacgttcaaaggtagataatgcattagatgaagatatgagttatgatgatattatagaattatgtaaagaatatgatttagaattgtctaaatcagctattacaagatataaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaaggcattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttataggggaaacaatgctctttgatgaaaataaattaaataaagttaaagattagggttgacagctcctatagtttatgatatagtatatgtatactaaaagtaaaggagctaacaattatgtttatttcattaaatcaagaagagaaagaattattaactaaagaggaaagtaaatacacaccattagaaacatcaagagagtttaacacacctaaagaagaattcattgtaacaagctataatgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtggagagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctcctcctgaagaacctgaagtagaagaagaaaaactatatactttaaatgagttaaaagagagcttactagatgctcaaggattaaaagatgttgtagctgattttcctgcatctaaagatttatatgaacctaataagttatatatctgtacaatacctaaaggatatcagtctaccgaagtacaaccaggacaatatattggtattagtactggattattatcagagtcagaagacttcagccatttaagaggtcaaatgcctagaaacttatatgaaacttctcatgttttaaaacctttgatacgtattaataatacaaatattgaataccaacaacatgagttacttgaagacattaaggatgacaaaaagatatatgatgtagagttagaagacttaagattagcaacaggagaagaagtttctcatttagaaattgttgataataagttttttgaaagtcgtattaatgaagttcttgaccgatacactgaactaacggattccaatgatttacttaagtactatagtaaattacgagaattagtaggtagtgacaaaatgatttattgttcactcctcgataaatgtgttaaaattatagattaatagtagtctcctcttatattataattgtaagaggggacatttttgtatagaggtgttaattatgtcaagaaaagcaagtatattctatatactagtggttattgttttggctttctctatctcatcttattatatatcttctttcatgtatcacgacaaagcaaaaaatgaagtctctactgagttatcgaacacaggaaagattaaagaagaaaagaacgtagaatttgtcggtgactacacattgaaaaaagtggaagataataaagcttattttatggaaacattacctacttacctaccaggtagaacaggagataacagcatagatatgaggtactacaaaacaagtagatttaaggaaggggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaactatggaaatggcagatttagaaagatttgatgcatttgtaagactaatttcagatgatgagctttcggaggaaagaatactggagttaagcgtagacttactaaacccgatactagaaggaggtacagcttacaaggctaaaaaacgtattaagagtaaatttggtaagttagaagcaaaaaattttaaacgaaactataaattcttacttaagtcgatagctcaaatagaccaaaggagataggacaatgacagaaagggaaaaattaattaaagatattgaagaggctaatagagacatacagttacagttaaaagaagtagataattataaggacagcatacgttctaaaggaacaagaaattatatttctacaaaggtattagattctattatggttggtttcatagttagttttttaatactcattataatgcgtgtacttgaatattttgtaacaggtaatgctgtttactcacctttagcgcctgcagttattattatgtttgttttagcactaggtacatggaaagtaagtaagatgaacaaaatagtatcttatagaggaactattaagatgtactgggaactaagtaatgctgagcaaaaacaagctaaggtatttaagtatcctaatgatgaagtagatattgaccagttatatagtgctgataaagtatctgttgatgcacttttagtgggtatcattaaaaattaaataaatttataaatacctgttgacagcctgttgacagcaggtattttttatagtatactttagatataaagaaaaaggaggtaatataatgatacccgtaatagttatacttattggactcatattatttttatctagcggttataagttggtattgggtaagtattatgatgatgtagatttaaaaatactatttaccatatttggtgttgggattgcattactacttggaggatttatattataaagcaggagctattttattttaaggagaggtaaatatgaattatagagattttattacagattgtattagcggtggttacaacgtacacatcagtgttacagaaaaacgagtacacattatttctgagatgacatcagcatcttaccctaaaaaggaaattaacttagatgaactacaagcttatgtgtactatatgaataattttggaagtcaaattacaacggaggggttataaatggaattggttattaatattgtagcagtattggttggtatgtatgctatttatttctatgttacaaagtttagtactggcttatcaggtattttaattgttttagggatggctattggtctttacttctacttagactatttaaatgtcagagaaaatgttattcgattagtttcagtaatgttcggagctttcttatttagtattgaaatgatttataataaaattatgttcgaaattaaaaaaagcaatgttcagaagactgttagagtgtatgataaagagcagtaatgattttaccataagagtacctaaattactttaagtgctctctatggtaccttaaagtagcttagaattgaaattaaggagatgaacaattatgtatcctgaaatagatgtggaagaattagcgtataagctaaaaagtacaagagagtatttagagagcattacaacaaaagaagtagaaatttatgaaatctatcatcttaaaacaggtaagttagtttttaaaggtgaatacattgaggtaaaagaattactgaggaaaatgtataaagaaaatttaacacttgtagatgtagatacaatgttaagcattggtaaaggatttattgatgtaattaagaatatatcggcagaaaatgtattccaaataacatataaaaaggagctatcaacaaaatgattaaaatattttcagaagtagataaagaatacaaacctattattactgaaaagtttcctaatggtgagattaattttaaatatgatgatttaaagtatttagtagaagaggacttaagatttgatgttttctttaaatgggaaaatgacgcagacttaatgcatttgtatatgtttactaagtatttagagcaactaggtattaaagataaagctgaatttttagagattgcatatctaccttatagcagaatggatagagtagaagaaggacataataatatgttcagtcttaaatacattacagaatttattaataaccttaattataaatcggtatgggtagcagaacctcatagccctgtaacagaagaattacttactaattcttttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggtgggacatttgtcggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaataaattatgctaaatccaactttaatgtgtgacttctataaactaagtcacagagaacaataccctgaaggtacagaaattgtatatagtacactagtacctagaagtaataaatattatgaacacagtgataatattgtagtatttggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacctagaaactattattagtactcaaacatggcaagcaatgactagtgctacactagcatatgatatgcgtaaaatgctagataaatatgcaatggaaacagtaggtaatattgaagcagtagatttccagggtcatgactttagtatgcgtggtatgagttctttagaaacagctcaattaagttcagcaggtcatgcaattagttttaaaggtagtgatacagtacctgtagtggatttcttagaatcatattacaatgcagacgtagagaaggaaatggttgttgcttctatccctgctactgagcactcagtaatgtgtgcaaatggtaattatgaaaccatggatgagtatgaaacatataaacgtatgttaacagaaatatatccaacaggcattttctctattgtgtctgatacttgggacttttggggtaatatgactaaaactttacctagattaaaggatattattatggaacgtaatggtaaagtagtaatcagacctgatagtggagaccctgttaaaattatttgcggagaccctgatgcagacactgaatatgaacgtaaaggtgcagtagaagtgctttgggatacatttggaggtactgaaactgaaaaagggtacaaagtattagatgaacatgtaggattaatttatggagactctattaactatgaacgtgctcaacaaatttgtgaaggattaaaagaaaaaggttttgcaagtattaatgttgtattaggtgtaggtagtttctcttaccaatttaatactcgtgatacccacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaaactttatagagaccagtcgttaagtgaaattagagaaataattaaaaataattaataaatatttaaactccctattgacaaagggagttttttattatatagtagggctatagtaaataaaggagtgaaagaaatgatttataaaatatcaaaacataattactatagtaggtttgaatattcatcttatttacctgatgaaggatttgcatatatagattatgtagatgtcattcttataggtgtagataatccaaagaagagaaaagttattactttaaaagcagatgagtttaatcctagtgattttaaggttggtcataaatataatattataaaaatactatggtttgagaaatgggaatggttacagccatagggaggagaggtatacaatgattatagataaattaaatggagttaaattagagattggcggtcatgttgtatcatttagtgtaagtaagtttaaaacgattaatggtgaaagacaattacttgattaccaccatatcaaaagaggtaaacagagatattttagaactactgaggaattctataatgagtacaaagaaataaaaccggataagaatgagatagatgaaatgtttgaatctttaggttacgtaaatactgaattagaagatgtagtaagaaaccaagagaaagtgacagagatattaggagttagtgaacagtatttaaaccaattgtcttataaggctatagaggaatatgtagaaaaaatagttatcttagaaattaaagaattaaaaggagagatacaatgataaacattaatgtaactgaaaaagaaaaattagttgtaggtgatttagtaaaatcaagagaagatggtacatggggtattgtagtagaagataagcaagacttaaatgtagttgtgttaaatgacgagccctggttattttataaatcaggaattaaaagagtagaagggcaattagaagaggactttaaatttattaaaaacagagaagagtatgatatagatgtagttaattcttcttataaataaattcacatctacctattgacttaggtagatacttattatataatagtatacaaggagatgaagtatgatgaatggaaaacaaatttatgtatttttaagtgaccaatacagtaaagatatactcagtttacaattaggtcttattaaggaatggtctaggagagaactaacttattcagatgatgtcggttcagatgcagatgttgttatttgtactgatatagtaagagatgatttcgtaaaaaaactaagtaaaaataatagcaatgcattatttgtatttattagttctagttattggataggttataaaggcggagaattctttgttgcagttcaagactatgtgaaaggtatgtaagatatgaaaaaattattaatattatttacattagctagcactttactattagcaggatgtacaccggataatcatgaaggaaaagttttaggaacaggagaatatagagagccaactacttatatcaagtcaggaagtgttactgtaccagttattggtgaaatgaaatactatgtagacttagaaacagataaaggtgaagaccgtgtttatcttaatagggaagtttatcgtaaatttgataaaggtgatgatttctctaatgtaggtaaaaaagtatataaaaatgatgaattaatatataaaggggactaattagtatgaaacaatttatacatgataaaaaagatagttataatagtacaaatcgtaattttgatattcaatattataaaggtatacctttacaacaaattgatagggggtatggtcaagcaagagctaggagatttacaataaataatacgaaccaaaatatatggatacctatgacatatttaaaacctaatggtactcttaaaaataacattgatatagattggatacttgttaaagaaaaatgtagtttaaagaaagcaggattagtaataaaaatagaaattacaggagatgtattataatgtatatattagaaagaacaattagaggttttgcaggtcaaacagaagatattttaccttaaaggagatgaattaataatggagtatgaaaaaatgattagagaaataatggtaaactctaaagaaatgtcactagaagataaaaaacatttaatgagtttattgatgagtgcttatggtgacttatcaatactagtagcttttgaagaagaaaacacagcacatatgtatgaagaaataaaacagtatgatactaaaaagttactgaaaccaagtatggtaagtaaagataattatatgaaataatatgtaaccaatcaggaggaataactaatgataaatatagaacatgattatacaataagaactgtagataatagaaagtatacttactatagtaaacatgaatccccagttactttatataaaaatattataagtaaagattgtattgaagtaactaaatatgggaaagataaaaaagttattatagctactaaatatattgtatctattgaacgatggtaattacaaggaggagtagttatgaatgctagggaagcacgtaaaaacactaaaaactataaggactctaatgtagtaactaaagagcaacacttaacttatatctataataagataaactacttgattgcaaatagtagtagtcagggtaagacatatgtggcaatgaatctaagaacagattatcctgatgagttttctttatctaaattaaaatatctaaaagaaattaaacagcactataaagacctaggatttaatgtgaaaacgcaagtaagaaaggcaaagtggtcagagaaaagtgtaatcaggtactactttaacttaggctatatagacagcgtgttagtacctattatacacattagttggtaattacaaggaggaatagttatgttttttaaaaagaagaagttaagcaatgtagagaaacaaataagacaaaaccgtaataaagaagacaaagaaagaaaagaacatcaagataagttaaatacagatatgtataaaacgtatgaattagataaaattgtagaagaacatttaagaaaattagacaatatatcccttgaaggattagaactaacttcagtgtgtttagggacaagacttgtttattattattcaataggcaaggattgggataaacaagtatatagtttaaacgaattagaatatatgaagaagaaatttaagaaactaggatttgaaactcagataacaaacgaagatataggatttcaaccttatatttatttaagattattatgggatgcataagtaattattattagaggaggaatagttggtgttgcacagttaattacggattatcatgacggacattaagtattgaatattgttgactaataataagaagaaaatattattactactaagtacctttgttatgtactactattactactactaagtacctttgttatgtactactattactactactaagtacctgggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctatgacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttttaactgatagttatgataataaagttttaaatactgtactcagatatattaatactactagtgatagagagcttagttacttaatgggtaaaggtgaagcggatgtatgtatagaaaagggagtatttagtaatatagaagatgttaaaattgactctgagtttattgatagaggtaacttatgtatacttataaatgaagatggattagtatgtagttactacagaggagaatcatgtaatgttggttcctttgtaaaggagaggttataatgatagaaattaggttaactgaagattataatgacttgagtcttaaggcattactaaaacgtattaaaagggtagctcctagggaattaacttatggtttagaagcggatatggatactacagatgttaatattggagattcagttccttctagaggtttatatgtagagtactcagaacgttttactagggacttatggataattgtacacccttcaggttatgatgcttattatcaaggagagaaatatggtggagagtctttagatgagattatacatgatatgttttatgattatgcagacccttttgacttagattattagaaaggagagattataatgatagagatataccttagtgaaaattatgataagaatttactaaaagcagaattaaaatggattaaagagaccgcttcaagagaactaacttatgatattaataggaaacctggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattatatacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcccagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaatttgagatgatttaaatggatgtaaaagaaattgcaaatactataatggagttgtggcaaatggacggctacagatgtgcagaacctccattatatgaaagcacactaaaccacacacgcacacacacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaa

SEQ ID NO: 15 - DNA, 142631 bp, Artificial Sequence
  Description of Artificial Sequence: Synthetic polynucleotide
ttatgtactactattactactactaagtacctttgttatgtactactattactactactaagtacctttgttatgtactactattactactactaagtacctttgttatgtactactattactactactaagtacctttgttatgtactactattactactactaagtacctgggaattcttttacctctctcactcagcctattacttattaccgacttccctaactacttattctatagttataatattcatttattatacaatacttaaactatagtattctactgttaatctatgctgaagcggtcttaatctatggttattatataataatcttatataatggtacattaatctagtatattacattagaatcattctaatctaggattttaatctttagaccctaggaaaagtggtactaaaatataaaaccctataggtatgggattcttatttttaaaattactaaaaagtattaggttttccctagggcaaagttttaatgtacttaaaatagtaagtagctacttatcatttagggttctataattgagaatattgagagataatccgcttcaattgtaattaattgttgacaactatgaagcgggtatgctataattaggtatagtcaaatttaggagatgaaatagatgattgatatatacttaggagaaggttataataaagaatacttgtctaaagcactcagattaatcaatgaccatgctcctagggagttaagttatgattttaataatgtagaagcggatgttaatattcacacaatgttatatgttaaacctgaagatagatttatatataaggatatatcctatgacttcccgggtgatttaattatttgtatagttgatgatgatgctattgtataccaccaaggtgagcagatttcaggtattagtattttaagaatactagaagagatattttaaggaggataagtaatcatgataggaataacaatattaattacgataatgagtatatcaactatctctatgtatatttattttttagtagacttgattcagtcaatcagatataatagttttgataaggtaattaacgtcataacatttgtacttatgacagttataatagcatcaggtattttagctatacttggaatatagagctcatttaagaagcggttaagtagttagaggggatttgtcctaaaatagtataccgcttctatatggaaggctgagaggtcttagaattgaaaggagagatataatgattcatatatttttaactgatagttatgataataaagttttaaatactgtactcagatatattaatactactagtgatagagagcttagttacttaatgggtaaaggtgaagcggatgtatgtatagaaaagggagtatttagtaatatagaagatgttaaaattgactctgagtttattgatagaggtaacttatgtatacttataaatgaagatggattagtatgtagttactacagaggagaatcatgtaatgttggttcctttgtaaaggagaggttataatgatagaaattaggttaactgaagattataatgacttgagtcttaaggcattactaaaacgtattaaaagggtagctcctagggaattaacttatggtttagaagcggatatggatactacagatgttaatattggagattcagttccttctagaggtttatatgtagagtactcagaacgttttactagggacttatggataattgtacacccttcaggttatgatgcttattatcaaggagagaaatatggtggagagtctttagatgagattatacatgatatgttttatgattatgcagacccttttgacttagattattagaaaggagagattataatgatagagatataccttagtgaaaattatgataagaatttactaaaagcagaattaaaatggattaaagagaccgcttcaagagaactaacttatgatattaataggaaacctggattggatgtttatgttaatccctataggtgtactaaagacgaagttgaagaatggagtacacttcctccatttgaagatgatatacttgtatttatagcggagacgtggatacatgaatatcttaagggtgaatcaataggtgtagatagtatggaagagtatgtaaaggagatgtaactaatgtttaaggtatattatacagtctaccatagaggtagtatgaaaactattaaggataagctagatagaagtagtttaatatacttcttgtatgatacttggtataaagatattagtaacgtattccctaatcactataataaagagtttgggagtaagagtgatgatatagatatagataaacttattgaagcggttaatgaggaaggtatattacttatcaatagaggtaattatgttacaataagagaatggtaggataggataaacttaggatagaaaataatttaggatgagttacaataggataggataggatagggggttaagttaggatggatactttaacatacactattattcataaagaatctgatagggtaatagctagcggtttaaatgagacagaaactatgaacttagttcaaaggatgataaatactaatctagttactgatatatcattagatgattatatacgcagaccacatggaaagatagatgtagtcaatttactagtagatattagaagacaaggcgtatttgatttcaatcacatttggcacgtaggataggagggataggatgatagttatatatacagatgtttctaaggattatttaaaagacgagttcttaccttggcttaatgaaagggatagatacttagaatactataaagatgaattacctgaggatatagattcctcttatattgtatcagttgtatactgtaaggatatggaaggtctattagaaagaaaagacattgttcttgataatagttataatgaacctgtagctttattaggtgttcctgagttttttggtaattatagtaattatttctattatagaggagaaagtattagtaaacatgacctaggagaaattgttaggttaaaagcttggcaacgtatgggtggggattgactaagtagctctccctaatttcactaagtagctccctaggaattgcctaagtagctcggtatgattttaccctaagtagctccctctgttttctactagtttattttaaccgcttcaggtgtctatatatatatagacggttggaataatatcagaccgcaaaaataaatacactaggatattattcccagtgtattatataatttttttatagaatatttataacattgtattcaaattcatttacttcatgttgtgatttaattaaatttttaattaatccgttttgtgttttatactcttttattagtttttcattttctataattaaattattaaattcttcttttgttgtttcctcatctacataaaatttactttcatatatttcataatattttttatctgttccgccatctaaatcatctgatatttgataatttttgaatataatttcttttgtttctaattcatttactaataattgtgattttgcatattgtaatacatcttcattgtcccacattggaatatagtttattttcatttaaatcaaatccttttcttataatttttttatataatatttgtagaagcggttggggtttgtcccttgccttactacactttatatattacagtatagttattcagaagtcaatacttttgagtaactttttttaaattcttttttcttctatataatagtagtttttagccctaaaaatgtttttaaaagaatttgcattttcttattgactttattatcatatggtagtaatataaaggtacagcaagggaacagcaacaagatattagaattatataaaaaaattatttaatttgagatgatttaaatggatgtaaaagaaattgcaaatactataatggagttgtggcaaatggacggctacagatgtgcagaacctccattatatgaaagcacactaaaccacacacgcacacacacggcgttaattgtttctattaatggaaactatgacacagtgcagatgttccgcaaaacgcctataatgagcatgagagggcaaagccaaccggctagcatgttagttaatgtgattgacgatgtaattataatcgtatatgaaaatgtagtgtacggagttcaaaacaaagaaataaaatttattgaagaaatttaaaaataggggttgcaatcctcaagcatctatagtaatataataggtgtaggggatagcaacacacctcaaaaaactttttaaaaaagttaaagaaaagtgttgacaccttacaagatacatgttattattaagataacaaataagacaagccacctagcaaataacgaaattaaataaaaaaattatagaataggatttgattattatgacaaacaaaaattacttatacgaagaaactcacacagtacaagggcaagacattacggctttcagaattccaaatgacgcaaacggcaacccacgttatgtagtgaatttcagggacttaggtatcggattatgggactatgacaacatcaataaactttacggatttaataaatatcgtgccaaatggtttggcggtggtgtagtattccaaagctataatatagaagatacattaaattttgcactagataatgttaaagaaatagaagcggttaagaattaaaaccgcttctgaattaaataaaaaatttatataaaaaggatatgataatatgaaatttaaaatagaaaaaaataatagtgatataaaaactttatggaatttagcaaaaaatggatatatgagctatcaaactgtacacaatatatttaaaaatgaatcagatgaatttattatatttaacagtaaacaaacttataataaatttatgaaattaagatataatagaagtgcaatacaataatataaaaaaaattatacaattccctaggattagatttctagggatttttatttattttaatttatataaaaaaattatttaataaataagttagtgtaaaattgactattgacaaggttgtattttttatggtataatgaagtgaagaccttttttagtataaaaaaattattatataaaaaatttatattaaatgattttagaaacgctctttcccggaacctcttctcttatatagcggacacgtaggctccttaccgctttcttactatacttatagtatactatagaaaaaagaaaaggtcaacccttttctttaatcttttttatatttttttataattcttctaacggttatttcacttatattatattcctttgctaacataggttgagtgtactttctaggcttgtatttgcttgctatggcttttctttcatcttctgttaatgcataacccctattatacctattgaaagtattgtctttatggtgccttttattgtgttctgacgggctaatacattctaggttatcaatacaattattttgtttgttaccgtctatatggtgtacatggtttgatttaataaaatcattgccaaaatattcatatacaagtctatgcaccatgtgttttttattattgacccttacggttaaatatccgtcacggtcttgatgtactttactcaacctatcatttatttttaccctacctaaattagaaacataaaaattatatttattaaagtattctttttttataggtttccaaatttcattaattttattttcaaccatttttttactcctccttttttggtatcacttccattatataataattcggtcttaatgtcaatagataaatgtaaaaaagttttttaaattaatttcattaaatctattgactttaatatcattatagtttaatataaaggtataccaaatgaaagggattgaacaaaatgataaaattcaaatggaaaaacaaaacaattaaatcaactcaaaaaacggataacattctattacttattataggtggtttagttgcaacaatcacacctaaacttgtaaactggtttttactactacaagataatataaatatttttttaagataactattgacaacctagaaacaacatgttaatattaagataacaaataaatcaataaaggaaatgataaaaatgaaaaaaatcacaacaactttaaacttaatcggcatgaaaaataatgaaaggtttacagaagagttaaaaaactaccgtcaagatgttactttcttgaaagcaaataaaattgtaaaatattcaaaataaggcttgacaacttaaacactacatgttattattaaggtacaaggtaagggaagcggtcaaccgcttccaacctaaataaaaaagtttaaaaaaactattgacagtcacttgaaaccatgatattattaagataacaaaaaacaaacagaaaaggaattgattataatgaaatttatcaaaactatcgaaaacttattaactaaagcagaaaacaaagggcaagcaattttaaacggtcgttattatgacggatatagaaacggtgagcttgaggaaaaatatgcaatcgaaattgatggcaacaaattaattatgcgtcattggggtacacaaacaattgagattgacttaagcataaatgaaattgtttcatactatggtgaaagcaattcagaccgtgacagtttaaacacacttgtatattgcttaggaattgcgccaaactttagatacttaccaagcaaagacttgttcatttacgaaaattaattaaataaagggcttgactttcaagccctaccatgttattattaaattgtaaggtaatcaagcacaacgacaaaataaactgaaaaggaattgatacaaatgaaattaatcaatagagataatgaaatcgtaattagcatagcaacacttgagagtgtaaaacaagccctaatttgggagtacatcgaccacttagataataacatcctagacaaagaaatacatgaccaggaagcggttgttattacttcagacactttgcaatcactcaaatttgcggacactatggaagaactagaagaatatgtaaacgacatcggttggaaattagtttagaaaaggtattgacatcctaacatatagatggtaatataagagtatagaaaaaataaaaaaagaaaaggatttgattattatgacaaatacaatacaagcatttttacaaggacaagaagcaagcacagttaaggacgtagcaactcatggagtacaaagcggagcaattggcaaattaatctacacatcagacgtagtaaacttctttgatagttacgagcaggacattgaagcggtcatcactgaatacattgaagaggttacaggacaacaatattatgacttattgaactatgagcttatgagagacctcgagaattatgcaaatgtagaatttgaagacgaagacgaatataataacattcaatttgacctagcagaaaacattgcttctgatgaggttgaaggatttgaagacatggacgaagcagaccgggcggaagcaatctatgaggctatggatgatgttgaattagaactacaagaaactgacaaggttcaatatgttaatctagcggttgagattgtagctcaaagaatggcactatagaaagcacacagagaagcttaaccgcttctctaatacaattaatcaggagatgttgaagatgaatacaagacgggtaaacagagcgttaaacgaagcagttagattattagatgaacaaatagcagatactcaaaagactatgcaggagttgaataaacaactagagaagcaaataaaggctaagcaagagctaatggtattagttgatgttatgaatggtgatgatgagtaatgaacattagagaggttcacaatgtcgttaagagtgctaagagcaaactcctgcaggagcaggctcacccaacggataacctcatagagcagtacatcaatgatgagctacacagacgcacacagagaagcggaacaatacagatgaacaataatactacttcatatagtaatagcccatatggtagcttagaagagcttagagaagcttatgacctatcgtcattatctactggtgagattaaagaactaatacaaacatttgtttaaattattttatcaaaacgctttacaatcttttagtttgtatgatataatgaacttaacaaattaaaagaaaaggaaatgatgaacatgacaaacttacaagaaagaaaacaagaattgaaaacgttactatttaacttagctttagagaagaacaaagcaactgatgagacactgcttagcgtattagagcaagcacatcaagaggtaggaaatcaattaagaaaagtaagaaaagaaatagaaattttagtagaagaaaaagaaagggaattttggaatgatatcgaatttaatggattagactaagagggaataaaatccctcttttatttttatcctattatataatttttttatattatacgggggcaggggtaaaatgccactcaatgggggtgggtctatatacccctatggtctacccaggtacttattttttggggaaaattatgaaaataaatatttaaaagtcaacacctaaaatatagaacgtaagtcaacaccctatattaaaagtcaacaatttatagtacaaatagagaacctctaaatataaagtcaacatatctaaaataagaaagagggaaattaaatccctcctcttaggtattattaacaacctctaattcatgtatagtaatcatatccatcccatagaaatctcttgggtctcctttaatgaactcttgctctcctctatggtttgtttcctctttataaccttcttctttaatacgtttaattaagttctccttatctgtatatatcttatcttctctaaaatggaagttatcttcataaggttcacaattatcatgttctacttggtatagtttcattagtcattttcctcctcttcgtaagaccatgtaccatattctgcattatagtgtgctgtatctgcgccttcatcttcatattctacactataccatgcatcctcctctgtttctgcatctatatatcttacctcttctgtagtaatagtacgttttactttgtatctcttcaactgtttttactcctttatattttcctctagtatttgttttaatgtctgacagtctttttggtctagagtatcccaactctctaaattttgtaattggtatagtaactcatttacaatttcatcgaaggcttctgcttttttatatacttcttctagttctgtttctgctaattttctattccttttaatttgttctgctttagctactaagatatgggctttattcatttcctctataataaagtttttatagttttccattattatttatccctcctattttctatccgttgttttatctcttctctattgcggtggtgctccttactcatttctttacgttccttatttgttaaccttatcctataaacaaggtagttaatgtataagataccggctgaccatagtagcaagaatgatattaaataagtccatgagatactaatttctatcattgtgagtcctccttatattctttatagctcttaatggctattttacaaatacctctatttacagcaacaaatactataaatgataatagtgttataactgctcttacatcccctgtaaaaggtaatgattgaaagagcaaatagttttctaaaacactaatagctgtaatagtagttagatataatatagataataagtaatcctttaattttagtttaacaaatggttttttgtgctcacctgttcttacaataccataaagtattatgaaccacataacaggtactaactgtataataaaatcattgtctacatttaatgcatgtagagcgtaaataataactgcaggaatacctataatgaatgctagaaatacataaaatataattaacattataggaagggctacaagaaaacctagaccttgttttgaatactctaatgtgtttttacctaggaacttaaaaaatgttttattcatcttcttcctccttggaattactttctgtaattgtaatttctaacatattattgtaataatcattcttttgattgatattatagttatcattgtattcattaaagtctacataaatatattcatttgcgtcattttcataaataatatctatagctgtaatatctgaatatgctgtaatcatttcataagcgttcgtattatcaggataagcaaaaccaacttgaggtatttccataggcttatcaataagaataccgaaataagtacagtgacgtgttcgacttatacttgaagtccctttatatgtaccatagtaatctataccttctgtaatacctgatatatggaacctgcttacgtctttaggctctaatcttacaacatcgcaattctctaatactaaatcaatatatttgatattcattttaactctccttttatattaataattttttccattctttatcaacctttttaagttcttttttattatagtccccgtctttagttactacagtgttccattggaacttttgtaataagctaaaattatttataatccatatattacttttactataatacatattgtcttcaaatcttatatctttttctataaaatatttatatattttatatcttctttcatctgcacctgatattttaataatttcattagtatttaattgagtggataactggaagataacatcttttactttcaataggtctttaacattacctctgcctacatggtcattatagcaatcatatttaacttttttcttttgttttctatcattaactacaatgaatatattatatacgatataagctttaaaatgggtataggtagtaggtgcttctgaatcatcacattcttttcttaggtctgtacattgtatttttaatgtaatattatttgatatgttaactacagtagagccctcatgttttttattaagatttatcttatccattttataattacctacttattgtagatacaatgtactcgaacatcttccattactttgcctaatagattctgacctttccagttactttgctctaatattttagggtcatttgctttaagacctactccccatattttatcataaggtgaagcttctacaaaatctttacgtacatctgtgtctaatattctttgctttaggtgtgtagtcataaatttatctttaactacttctaccataatattatatcttactttattccactgttcttcattaaaattacgaactttacgacctaaacttttagcatggtttgggttcttagcatttagtatttcacctgctatttgaaagtcattaaagtatcttgctttgcgccacataaaggcttgctctgagttattaaatgttcttccttggtgtttaaactttatagggtagaaattagaataaatatcctctttaccccaaaacataatatattcccttgtttctctcataatatttctcctttaattccatagtgatggtaatacaattttaaaattatctaatattttactttgtacctgttcaagctcatcatatttatccatatcaaaatcatccatttctttatgataatattttattaagcttaaaatatgttttatcatatctatttgtgttctttctttgccgtctacatctacaaaagtatggtattccatatccacatgattactactctctataaatgcatttaggtcagcgtatagctgaataaaaaaggacatgtcataattccaatacttaggttcatttctacctagttttttcttcattttcttatattttttattcttttttatcccaaaaacttctttttcaaagtcattcaatttaagacctttaaaatattttttcttcatttcttaacctccaatttaataaatggaaaatcaatgtttctaaatactgcgccaacatcacacattaacatgtctccattaatttctacttctccactgtctgtaggggtgtgaccacatacataggtaaaaccatcttttctaggttgaaagtctcttgaccatattaattggtcaattgtttgttcttctacaggtttccaactaaccccacctgaatgagagaatatatacttgtcttctttatagtactttctacaattaaccataagtattttaaattttctatagtcgtctgattctttaagtttctttagttcacttttaataaaatcataattatttcttagattttcctctacactactatattttaaagttactgtactcacaccgtaagagttaagtgtttctatacaatatcttgagagccattcaatatcatagatacttaatcggtctacgttttccataatattataaaactcatcatcatggttccctaacagagttactacattatcatcattagacattaaatcaaatatatagttaacaacatcttttgaccttttacctctatctacataatctcctaaaaatactattgtttcttcaggttttctttcattatttattttatccataattgttaataatttttggtattctccgtgaatatcgggaacaacgtatatagccatctaatctcctccttattgtatataactatcttaccatacttagtaaaaaaagtcaataaaaaaacacctattaaattaataggtgtttatcatttaatgttattttaaagtatcattaccatgtgctaattttttatcatctattgcatggtcattataaatatatttaacctctatatactggtcttcacttttcagtgcatctactatagaagcattattagttattgagcttgttctagggtaagtaaatttttgaccgtcagataaaataatagtaacatcaacttcaaagttaacaggtagtctgtatccataatcttccaaataattaataaagttattaagagaaaatggtttatacttgccatctaaggtatagtcaatatattcatttaatgcattagtaagttctgattctgttaactccattgtatcataatctttttcgttatagaatactacaacattaggttgttctatactagaatctccgtctttatacttagatataaaaaatccaatatttcctttatgctctaaataatctgctttcataattttaagtacttcttctgctataggttttgctaatagtgttacccattcacctttttctgcgtcataaacactaggtagtacgtttaccatcatttaaatctcctcttcttaatttattggtttaaaccacaatttactcttatcacttggttctgtttcactaactacgaaagagttagaatcaatgtttaaagtattaaaaacaatttcttgtttgtcttcattactttttgttgtaaattcgggaacatctgttaatatagactctttaccattaatagtccatgatattttaaaagacccttggctatacactgtattcggtgtcagtttttcaattataattttagcggatgcacctgtaattttttctgaagattttaataatttacctttggaatcatataagtttaatgttctctccacaaattttatctcctttactatattttgtacaattaatataacaaaaaaacacctattagtttaaataggtgtccgacagagctcccgtacttagattacggttaataatattttacgacaactatatgagaccctctgtcgttgaaactcttgtcactgcgttattccacaagatattttagaaggtagcttgtggaagaagattgtttttaaaggtacaattagcgtttttaagcctattcgatacccaggacactatgtccgtactaactattacgtcaataaaggttctacggtctcaattacctactctttattgttaaaactaaaattaagcttgagtgctctagaagccaaaatcaattaattaactatagatacggaatggaggggcactaccatccggagtctacggtcagatacaaagcctctgccgggcaacatacggtatctctcgtacatcaggttgactagacctttagagtttttcactccttctcttataaccagtaacttaagagaaataggttttacttagtagatatgaaacaataaatccacatacaatattaaatcatagtcaagtgattgcacatatgtctaacacctataagttttttgctagcctggtatatggactctgcaggattcgaacctacagtcaaaccgttatgagcggttggctttacctttaagctaagagtcctagaaatatcctgagagaggactcgaacctcaacgactaggtagctacatctagccaatgccattactcaggattgctagtaacgctaaatagaattataacgttaccgtagaccttttctacgcttggtagataggtaaaatataatgatttcaaagtacccatatagttaggctcttattctcattataaggttaaaaaggctaactgtgtttagcattatataagaggctttagttaactactatactaataatataccataaattatacttaatgtcaagttaatttatcaattgaatctataatttttgatgtgctacgtatatctgcttctttactatgtttaaggagatattttaatttcattaaaaaagaatttttttctttttctataatatcttctttatcatcatattctgaaaacataatgaattctatacctatactatttctattatgtgaaaacatatttatagaaaaaggtgaatcaaaatttttatcatctttattaatactaaagtcttcagtaacctgtaagtcatttatttcagatatttcaaagtaaccattaactcttttaagttcaatataactattgtatctaaagtaacgttgttcttctattaacttctcttttgttatataaggatattcatttatgaatataggattacttgttccatagttatctctaatatattctgcatcctctagggaatcagtataacctaaaatttcataacttgttgtatacactgtatcttcttcccacaagtcatagtccatttcctctatttcttcttctaatatataaatttttttcatatattactcccaaaccccgataagatttttaagcttagctataacctcttcttctgtttgataagaaaatacccctgtaatatgttcatagttacctacaatttcataatcttgtgtaccatgtttatctactaagtatgagttattcataacatttaaactatcttctgagtaactaaaatttatgttatagtctactaaaaaattaataatatttttcatttacataacctctcctatcggatattgtcctagcattcttgttccattttcattataaaaagtatattctactacaataatattcatcatatctacatatatagcttctatatacggtgtaatattttcctcttcttgtatgtgtttacctatgatatcatataataattctgagtgtattcgtttatctctcattatagacctccgtaaggaattctacagttttgtctttcaaagatttttctactaattccatagcatctttatagtgtttgatattagattcattagacttaagtttatcttttacttcttgaattaggggctctactttattaaccaaatcttttttcttttcaatacttacattgcttctcttattgtctaatacttcttttggcatatatttaacttttgcaaagtctttatagctaacatttaagttatctaaatcatctaataaatcattatagtattctaaatgattatagaatgtataaaacttaacaaggtctttaccagttaattctcctttttttagtatattattaatattaccgataacagaatatgctataggcttaaaattagctctaacataagttaaaaatataaaatcatcataaaataaatctaaaacagttttattgaatctagtatttttagcttgctctaattgagcacataaattaagaacattatcaaacccactttttagaactaaagagataaatctttctactgcatagtatcttgatacttctgtatgcttacttgctttttcattattcctaaatatagtatctgataaaggttgaacaactaaactcatgtaatctttatctgaatgctcatctgatgttccttgataagtacttccaaattctattgttgataataagaaacttttttctaagttcattataacatcctccttttatttgttatttaaataataacatatattgataataatgtcaatacttatatatcttcttctgtatcaacttcatcttgtttatacttaaagtgttcatagactttaaatagtataatccctagtgttattaatcctaaaatatatttcatagcaatcctccttaataaccatgtttagttacccaccctgctaaagcatccatagctatatcatattcttcttcatttttaattcttataattttctctatttcttcctttgcttgcttagaactaataaaatcaatatcagtatcctctaggttagttaattctaagttttctctaataaaattcttttgacttggtgttatagaattaactcttacattttcgtgatttagaaattggtagaagtccatattactcatcctttttaacgtattctgccatatcttttaaaatacttagtacatactctaaatctctatattggtcatctaacgaacctataatagcatatggtgtcatatcccaggcatgtgcacagtcaaaccctaatactctcttaccctcatagtcataatcatcgtaagtgatacctctatgggcacgtctttctaaggagtcatattctttttcattgatatctgaaggtaaagttatatatccatttagatgaccagtttcagggtgtctcttaacagttagtttaactcctttataataaatatcaagacttaaatcttctcctagaatattgttttctttttctactttttccataatgtattgaggtgcttttttaaacataattagtcatctcctttttatttatatctttactatacactattttttatattttgtcaacaaaaaaaggctactaattaaagtagcctaaatattaattatttagcgttataagaccaacgccaataaccatttttctgtgagaactcaaagtgaaaaccatcatagtcaaattcaatattatagtctccatcttgaagtggttttgaatttagtacaggactattactctttgccaattctgctagaaactcatgatttactttttccatagggtttattcctcctaattattcttacagtactaatatatcataggtctttttctaagtcatttttaaaagtttcctcgtaagaactagcgtaagtaacctcataacccactacgttagtatatcctacatataatgacttataattagattttatcttaatatcttctgattgttctagcttatttaagacttcacctaaatcatctgaagaatagtgttcattatctattgttattgttttaccttgggtatagatatcaatttcttgtatcatcatttcatccttttgattattcattatttgattataagtttctaaatcatcaatgttatctgtatctgaaccttttactaaccattctcctctcttcttaaggaggtcatcaaacttctcatgctctttaattatcttttctacctcacttggtattaacacagccctagcatagtttatatgccacatagacatattatcaataagataattaaccattcttataatctctttttcatttgccatataccaacctccttatatctattactaatataagagaaaagcagacttattaaaagtctgcttctgtacctaattctaatcttctatttttcatatgaggaatcatttttttatctcctgttaatagagataattctctagctttttctttagataatgttagtagtccattataattatctactttactattatattgtctgactaagtactctagttcatcttctatacctgctagttctcctgatttaactccaagtaactttctatacatgtcataatcttcagaaagactttctactttgtttttagatacagaatcataaactgcttgtaaattaccttcttcaataagtttaaaattatattcaccaatgattaattctttttcagaagagtcaagggtaactaaaccacttgtattacctgtaaagtcacctttataatctacaacaattccttcagttattttatctcctaattcaatagttccatcttcattttctttaaatttatgagcatcataaacttctactttatcacctaatctcaaatcttgagttaagttatgtttaccaataattctatccattacttaacctctcctttattaatagggtcttgtgttaagaacatttctaagttctcttttgtaataggtaaccaaaaatatttactttccggaattgtaactgtatagaagtcttcatcattattaactttgatgttaacatctgtaaactcatcttgcattaaccaatgggttacagttaagttatatgacccatcactaacatatcctaaatcaatatcatgtctaaaagccaaatcttctaaatgttctaataaatcgttcttttcattatgtttttcttcttctgtattatttttaattgggttaattaattctgtacaaacaatatcatacaattcaccatctgtaacctcatagttcttttcaattaatacatcttgtattttattgattgaatttgtaactactttcccatattcttcttctgtaaacttacatttatctaaatcaacatctgtaattaattctgcaatccatttatttaaaattgatactgccattgttcgagaaataatactatcgtataccatatttatttaatctccttatttaggtgaatgtggtcttctaatgaaaaatcaaaaggcgctacaccatttcttttattatttgtttcttttttaagtataacataagttagtgaaaaagtcaagatagttactacaaccattgataaaagtttaatcaggtttttcatagttactctaactccttaagtttattttttactttctctttatcgtacttataatctttactagagttttcatttttttctttctcttcttcattaagttctctatactgagcttcttctacctcttgttctttattatcgttatcttcttctgctttttgaatttctacattcttactactaccatttaccttttttctaaaaagaaaccaaagtattaataaaatgatgagtaaaataacaatgctcaatacaacagcccaaatattattagccattacaacctacctccgaatagtttttttacagctcttaagttttcagatgaatcgttatttatatcaattcctacgctagaatcaaaaattacagcattatcaagtatatgctctgttaatttattaccataactacttttacttaccacactaccataaccatgattagttaggtcaaccatatcaggttcaacttctagtactctaaaagatattctacgtaagaatgaaggatttactaagtaaaaggaagatttaaaaacatttaatctttgataagaatgttttatattaacaacaaaccctgttaacttatcttcatatcctgaatttgataacttacctaagtaaaggtttatactatatccttttgtttctaatgtttgaatagcacttaacattatagcccctctgtaagcaagattttcagggtcttccatccaactaatactagaattataaaatacatcaataactttcttctctgctttaactctttgctgagacatcatagaattaggtaacccttttatagcattaggtacgtgaggttgatacccttccggagctacgacaggttttctttttactgacttatccattctaaataatgcatctgtcatttttttaagtttaactaccatatcatatgactctctatcacccttaaccattaagttataggcttcttgaaaactatgagtccctgtaaaatcatagctacctgtatctgatgaattatctctacctgaaactctattcttttttaaagcagaaaagaaatcaggtagaccatcatatttaattacatttaattctgagttatctattaatcgtctacccattgattttcctcctattctaatcctaatttatccataattgtatcaaagtccattgaatcttttgatgtactatcagattttctaggttcctgcttaggctcttgttgcatacctaaaagctttcttgttgcttctgtgtatctgttaccctcaggtaaagagctaataaattgattaatctcatctttcggtacagatttaaagataatactttctacaacaaactcatcttccattactccatctaatttactaccattaataattgcacgcattgagaatacataaggtaatcctttttcatcattctcatgtcttaattgttgtacaaagttaactaggtcttcattgcttgataactgatgttccaccttagtatcatagtcaaattcaacttgagcaaagcggtctaatgtagctccgtctaattgttgtctacctacataaatatggtctgctcctgttcccatagtattacctgctgacacaactctgaaatcttcatgagctgttacacgtccaatagggaagtcaaagtatttatttgcaatagctgaattaagaattaatagtacttcaggaatagatgcatccatttcatctaagaagaataacccaccttttgtaaatgctttatagaattgggtttcatgaaacttaccatttgcatcaataaatcctgttaatttaaattcttgagtaattgcattactgaaataaaaatctaaatctagagcttctgctacttgttctaatacatggttcttacctgaacctgctccaccttttaaaaatactggaatattttggttaactaactttagtatatcttggtatctataatggaagattcctgagatatctttaattgttttttccttcttgttgtaattcaattttaactggtaaattactaagttgttcttctacatattcttcaatttgttttttaacgtcagtaataataatttctctactctcagttcctgctttctcaacaattgcatctacaattgcttgttcatacggattagagtttttctctcctagtttgtctgccaagtcttttgttgtttccatttgttgttctaccaatctctctaatctttcaatagtatcttgctttgccatatttatcattctcctttgatttgttatacatttattatattacaagtatttgtatttgtcaacaactttctaaaactttttttagttgttaataaaaaaaaataccttacacctataacttaacatagggtaaggtaattgtcaacacttttattaaaaatacattaatttaaaaaaatcatcaatatctttagtttcatgtgtatccatatcatacataaacatacaattatatgtatgattattcattatttctaacatgttatgcatagaagttgcattattgaattcctctaaatcaatagttaccgtaagttcttgaccttcataaagtatgtttgctatataatatttcctaacaccttccattgttccatgagaagtttcattatgattaagtacttctacacctagtgaaggtaaatattctgaaaagtaatatttacagaaatatataaaattgtctgttcttttagacacgagtactatctccgtactttatatttctttctaatcgtacataatatgttttaattttttgtacttctttatctactgcatcctttcttcctaaccttgtagtatattttacaatattaaatatcatagaatcaacaaagccatcataagaaaaatgttcttctagaaaagaaataacatccttactacctttatagtgttcaggtaaatgtgcatctacttgtatattataataatcttctaaaagacctatactttcaccaagactagataaagcgtaacctaaatcatttgaatcattagaccattctttagatactgatagtgcatcttctataattgttacttttaatttatctaaataatcttctacttgagcttgtgttttcataaattcttttgcgttcatgtaataccctcctaaattatataaaaaaaaacaccctgcttggctacaagcaaggtgaaaaaggaaagatattatggaagtgtactatctaagtacacctcataatataacagttttccttgctagttattacttattttttaaggtcttcttctttgacaaacactccattaataagcttaccttttctgtcttttatctcatcataagccatatcaatacactcttcaatatctatatctaactgtaaacatagtactgttaatactacaaaaatatccccaacactatctcttgttacatggtcattacttttagcaatacctgaagctaattctcctgcttcttctaataactttaacatttgaccttcaggtttacctgtttgtaaatttctatcttttgcccattgtttaataagttctactttttccattattctatatctcctttaatttctgtatctttgataattaggttatcagagtcacttgttacatttaaattatcttcaactaattcatgtagattattagtaatatcttcttcatacctataacctacacgaacataagctttaactctgatatctatattaacataatcttcttggaatttttccatttctaacttcctttattatatcatattatgatactattgtcaattaatctgagtagtttcctttagcaagttgatactttttgtgtaattcttcatataattctctcataccttcatagtttctcatatcatcttccaagaaactaaggtaatctaataatacttttacatcctcaggttctaaagttataactggttttaccattaggcaacctccttaaattcttctttatttattttcttgatatctttttctaatgcttcttttaattcattaggtaatttataggcatcaattgattgttgttgacctaatacataaccattatctgtaatacgtatttccactgtaaaccatgaattatctaaatcttcttctaatcttgctaataatattaaacaactattttttagaattctgttagcatacccaccaacacaatgagataacattttaccttcatctttaagtttacttacagtatctgcaggaaggaattttacttttctaccatcttttaatttataagttttatcaattattttttctaatttattatcatatttagctttaagttctgcatcatctaattgttgttgtatagattgtttctcatctgtaactatatcatgttctagttttagtgaaaatggtgttaaactaacactctctaatgttctataaccttctcttattaatattgataaatcatgtaagtaatctaagtaatagttatctagtgcatatcctgttatacgttgtctgtcttgagcatctacatctaaatagtgcgtcatctttttgtaattagcaaaagatatagataatatttgattcacaataggtttaacttttaaagcatctgtaacatctcttgaatctctaaccattaaaaaggtatcgtcaaacaattggtgtaaattaacttcattgtgtaaatgattatagtgcttatagagaatattagcaaatcttaagtaattaccttgctcaaatttatttaaagttagtaactttttataagtctgttttgtaagattgaaggcttcatgaactttccatttaggttttttaggtatatggaatagtaatgcatttctttcaaataacccaaattcttctaagttatttattttatcaatatttttaacaatatctgttaaagttattaagtaattagaagttgaattttctcctataaaaatcctatatttatctcctctataatttatatgaccataaacatctgtattatcaggacaccaactagaaaaatcaaaattatggtgctctaatgtttgttctattatctttattataattcctctagttaagttaggttgtgcatagttttttaaaataacatttaataaaacagataaagttaattcattcttatattcacttttactaatatcatctttatataggtttaaagttatttctttattaacaagactatctgttaagaaaaccttaacttctcctgttttaacgtcaaatgaacttttattttctaaaacccatttgttacccatattatgtttatctctaatatgtttaactttaagaccaaaagatgaatagttttcagtacttggatgcatgtaccaaacacggctatataattcatctgtcatagcactatagtactcactagaacctttttctatatcttcattcataacaataatagatgactttataagaccatatttaccttggtctagtacatccataatatcattatttaaactatctactacttttttatattcttctaattgtctagattcattcctccataaatggtcattaccttctagttctttaattttttcttcaacataaccttttgattgtatacgtcttctactcttataaccatatacaggaaaatcttttctttcttctctattagattcaatatactctttgtaacttcttcctttattatcatcaactacaccttcaactaatttttcaactgtttcataagggttaccttcaaagtttgttacttctttattaccacatagggctaaaaataaatgtatttctgtggctgtatcaaaactaaatatattatgaatatctctaaataattctttagaacctaagttaattatattatttttctttttcttaagaaatacatcttcttctcctatatagatacatcctttattaaccttaggtaaattaataatttcttgttctgttaatcctttttgtttataagttattgccatttaaaatcactccttatttgttatgtactaatcataccatagtaaataatatttgtcaacaaaaaaagaagaactttttaaagtccttctaaatgagtttcgtatataactttttgaattttatttaatggttctaaatctaaattcataataagttttttatactttcttgaatttttaaaattgatagtatttggcatagcaagagcttcatcaacatctttagtatagcttacaacatctgaatagatatctacttcttttacatatagaccttgagttaaactcctaaatactacctcattatgtgctataacttcttctttcttttctatgctcatttataaacctcctggtctactctacacaaacaagtacgtattctaaattagttaaagaaactgatttaatattgtttaattcttgtaatttcttaatttccacatcatagttcttacttatagtccataatgtctctcctgctcttactttgtgataatatttatttccctctttgataaggtcattcaatattacctacccccttgagtaataattagcttgtagataacatataagtataagaacaaagtttacaaattcagtagctataatatgaacataggtatgtgttaaaaccatacttacaattaatgaagctaatcctaatccaataataagaaatagaaatctatttgttccttctgcacttttagttttataaaaggttgttatctgagttacatacgcaaggataatagtaatagttgctacagtttgtgttaaggctgtaaagtcacttaataaaaatagtaacagtgagaacacaataataaaaggtatagagaaatagtccttttttctatatgaagctactaataagcaaacaatacctaaggttaaattaagacctacagatactatttgaaatactgaagcatcagttaataataagttgtaaaaacttatacctactgtagctacaattaaataccaaaaatagttactaactcccttgacactttctgctttaactaatgctactaaacctggtatatatcctactgtaattaatatagcatataatatacttaagtaatgtgataaattatccatcttgttcccctaatttctctaatctattaataacttcttcccatgaaataaatccttctccgtctgttagttctaaaaccataccatacacaaattggttcgtactaaattcagctctgtcagggtcattgtatggtttaccatgtccttgtctaatatccgagcagtagattaatacgggtttatttacaatgttttcaagtttatctactattaattcttcttcagtatttaatgacgtttcaaacttatttgtaaaataattaaaatactcttctccattatcatatatatggttaattgtttcttctgcttgatgtttcatacctaataaaataccgagttctgcaattgttcctaatccttcattaaggatatcaaatacaaaaatatctgattcttgcatagccttaaagtcattagttaaaatacgttctgctagcttagtttgttctgcattagctttatcatttattgacttatctttgtgagggctataaggagttactcctacaatgccatctacttctttatgttgtttatctctgtaatctaccatagcttcatttaggatatgtccacccatataaattactttgtctttaattttattacccatctatagtatctcctttttcttctaaaatttctcttaaaatatgtggcatttttttcttaatttgtttatctactattttcagtatattttctttttcttcttccataatatcatcaacaaagttttgacctacttgtttcataattagaccgaagttttctaattctaaatcatcttcagataatctatcttcttctatagccctaaaaatcattttttccattcttgctcttgtaatggcataatctgccactgactcgttcttttttacttctgttttcattttttgacgactaaattctttaaactcattagatactaatttaaagtagtcatcatattctgatttaccatctaagtatttaattactataccttcacccttatcaggtttaactgtcatgtcagattttcctactaattcttgaatttcttcaggttttaaatcatttaagtagtgagatggtttagatactagcaaagttttaactgtttttaaccctaaatgatgtgcaattacattcatgtcttctactgataaataaacttcattttctttatcataaacatcaaatacataaaaattgttgtaaaattcttctttgtactgaatcttatgtttgactaaccattcaccaaaaataatgtatttttctaaggctgatacgtacgtatttcttacatttatattttcatgtacccaatcataaaaaccatttaaagtttcattctcatttaatttttttctacgtgaaaaacatactaattcaccattttctactgtgaagcttgcattacttccatctaatttttcttgtacaactagacctctttctttaaatttatctagtacaatacctttattttttactttagtatacgatttcattaattatcctcctttgaattatgtactatagaaaacaaaataagacttacgcttgctaaaaatgctaatactactaaaccaggtaaatttaaaactgttgataagaataatgatattgcacttataacataaactagaccgcttagaaataaagttaataatacaattgttataagtttcaccaaccaattgttattaataaataccttagctaaataattcataaaaaaatcctccttagttattatagaataattataccataactaaggggatttgtcaacatattattttaccatttaaaattatctgcatattgtgcaagcttagagcggaaattaactgtaaaattatgaaatactgctccttcataatttttaaagtattccatataatctccaaaacctgatttactttcgttctttaaatctatttgtttaaaattaccttctactattacagtagaattttttgtatgaacccttgtaagaacttttttaagttcactacgtttaaagttctgtgcttcatttataattatagtagcatctcttagatttccacctcttaggaatagatgggatatttgagatacccaacaatctcctagtttatcttctttaacattatcttccatcattaacatttcagttatttgttgttcaggattcatattaagttcaataagggcatcatgtaatcccatgaaataagccatttctttttctgtctgattacctggtctgcttcctaaatcttctgatactggtgaaattataaatactagctttctatttttattaagatagtctgcgtaagcacaggctactgagcacattgttttacctgtaccggcttgactctcattccaaagtatttcaacattatcattaaagaaatcctcacagaaatctaactgctcggttgtagctttttcaaggaattcattaaagactagatgttctcccatgttgtatcttacattaggataatcttttaacttaaagtctaactcttttagttgtattgccatattttaaagttcccctatctataaatagttttactctcttttaatatagtactaatttccgatatattctcctgttgaagagcaataattactacattcacattcagggtagttatcacaaacatcttcatcttctacatcatcataaccaatatcataattattataattaaaatctacaatacaattttcactattacctttagataatcctgtataaataatatcatccacagaatcccaatcgttatctgccaagtaatttacactatctagtactgattcattatcaggtaaataaatactaccgtctgaaaatttaattaaaatatcaccttgaggtaaggtatcattaattaaatcaatctctgtttcttcttcaatagtgaatacagttccttctaatctttccggtgtagtatgtgttaaatgttttacagtatcccctgattcttcatagaatcctactgcattcatatctttattatattttgcaataaatttaccattgtcacttaccaaatattgactagttgcattatagtcgtttgcgtcatctactgtcatgcaagggttataatctttaacataataactaattttcctaacatctgctgtttgtactttcttaccttcacctttaattactgaattaattttcttcataatattttctcctttttatatatcaattgatttttttgcaagattatcggcatagtcattccatttgtcatttgaatggctctttacttttacaaagtttatatctattactttttggtattctcgtatcatattaatatatgttttacttagaatatttcttgcagaccaagtaccttcataccaatgtattaaaccaatataatctatataaactattgcctgattgtatcctagttttatagcctcttcaataccataacaacaagccaatatttcacctgcaacattattatactttattaatcctggtttgtcaacacttttactaatttccgatattatatttccttctttacttaccaagacagcacctgagcctactttacctttattatatgaggagctaccgtctgtgtatatatttacactatcctgcatacttataatcctccataaattgagggaattcacaatctgaatagacttctctgcaaaaagatactgagatatagttaaaatcaaaacatttgaaacagtgttcttgaacttcttttttatctttagcaatcacattaaatttaaaaccatcagctattactgtaaatactccttttttcataaaacaaatacctccactaattttattttaaattaataactaactcaataaatgatttaatagttttatttttaccttcatcaatatctgaaaagaaattaattaaactgtcatcctcatcaaataaatcttcaacatcatcaaatttatttaatatgtctgtaacactgtaaccctcttctgatatatactcatgtaagtcttctccatcttctgacagtgttgcttctattttaccatttttactttcaattaaatataaagtatttaacactttaacagaatctacaactacactgtagttactaatagtaggatactctgtataaagtatttctacattagtattcatataactatcaattacagagttaactgtatctctttttagctcagatacattatgttttcgtatagtaggaaattcttcatcatattctactaattcttttctatctgtattcaataacttgtctaaagaggacaacaatactattttatattggttatcaggaagactgtctgtaatttccattattgttaaaaacgtatcttcacctagaactttgtttatatcttgtaattcaaatgaatctaccatttcaatagtatcatctatatcatctgtagtcattaaaaaattaactaaattattattctccatcgtcttcctccaattctttaaataactcttttcctggagtatttaacgctttctctaaccgcattaaattagcacttcttggtttcttttttccatactcccaataagatataagagagtaatgaacacctatctcagaagctagacttcttaacgtatgtcctttttctactctaattttttgaaggtttagaggtttactttcctttttttcatccataattatttctcctctacttttaaaaatttaaaatcctcagatgcttttgcattttttagtatatactcttgtgatttatttcttgcctctgccttacttttagcatataactctatatgaaatacatgaggtttttttaaagacggtgactcgtatctccaataaactttaaaaagtagtgtttctttttttaaaacattaattcgaaaccatcttttaaatttattcattcattatcctcctctatttatttgttaaactaattatagcatagttaacttatgaagtcaactataatatacaaaaaaagactaagaaattaatcttagtcttaatatattaataactattatgtgcgttgtggtatgcaagagctcctgatgttgaaccgtaacggtcaatcatatattgttttgcacctttagtttgttctgctatagaaccaccactccatgatttacctaatccttggaataatccttgagctcctgatgatgcattaacagcattagggttcattgtagattcacgcatagcaatttcaatcattgcctcgtctccacctgcttgtctaatctgttctgctacagagcctcctgtagaactagttgattgtgtaggttgtttagtttccttttgaactggtgctgatgttgtttgtacttcttttttagtatcttgtttattttgagtatcaaattgtgcttgttgttggtctactttttgttcaggtgtttgttcttctcctgctaatctagatactgtattatctacttgagttgagcctgaatggtattcataaccaaagttaccattataattatagaaatgataagtaaattcaccatcactaaaagagaaatcataattacctgcttgaattggttttgtatttacttctgctgaatttgatttagcttgttctgctaacttattataatcaatttcgtctgcactagcttcatttgtagcaatacctccaaaagtaatagctgtacctaatgctaatgttgcaaaaattgttttcttcataaatttaaaactccttaaataattttttagaattgtttatttgtaaaccgacataagtaatcataacatatatctttaaataacgcaagtataatatagcactaattagtgtaatattattaaggttttattacaaacattacagttatcagataattaaatacaaaaaaagagaggtaattatatttaccactctccagtttcattatatttatttattacattatctcttaattctatagcctcttctaaagattttgcactaaaatatttaactttattttttcttacaatttgtatattatatacattatttgattttttgtatatattatgtgtacttttctttcttatattagttgagttttcagacctagtagaccacttaacattaccaggttcataattaccatcattatttattctatctatttgataattttcattcggagggtctcccatatagtcgtagaattttttaaaatcattcttccattcttcacatatttctataccccttcctccatagtttttataatttatagcgttaacatcgtaacaacgctgtttcatacctaaccatctttggtacattgggttactggataatccatgggtagtattcctttctctcattaactcactatgaattttattactctcacacccacaagattttattttaccttgccttaaagtggagcttctaactattattacttctccgcattcacataaacattcatacattttacatcttgatttatccctcttactagactcttttataacttttagtttattaatagtttctccaatcataatatctcctcctataataaaactatagcataaaaaaccacctatgtcaataggtggttaaacatattatttatttaagtttgtaataacactatctgaacctatactaataggttgttttccattccatttttcaattaattgttgttgtaaaacttcctctgttaaggattcacttctaatgtcattggctttcttttcaccttttgcttcaatttctttctttttagcgttttcttctgctatttgcttatcaactttagtgcgctctagttcttggtttgcttttactctctcatcaattgctttttgagtatttttatctgcagttgggcttgataatgcaatatcatcaataataaaaccttgcttttctaaattatcattaagtttatttaaagtatcttgtttaatttctcctgtttttacaccaaaagcatcaattacagagtacttagaaattgcttgtctaacattatcttgtactctagaacgaagataccctttttcaagttcttctatgtcagcacttccgaatctattaaaaaggtttactgccttagttgcatctactttataagatacatcaatgtctaatttaatatttttaccatctgaagttgctacatttaaatctttatatttatgtgtttgtgttttagttgggtatttatttaccttatcaaaaggtgctgttaaatgccaacccggtgatttagtatcttccttaacaccatttactgagtatacaactccaacatgaccttgtggaatcttagtaatacacattaataaaataataaaccctataattgctaaaaaccctaatactcctgaaataactactgactttctcattacatttctcctttttctatttcttttattaagctatttaaagctttttcctcttggtctatttcttgtttatcggctctagttacaattgattgtctacggtcatttaagaattgttttttatactttacatattgttctaaaccgtattcatctaatgtaccttgcctaactaattccctgtattgttttcttatgttactcttcttctctttcattgaaagaaaatcaaataaataacttataccaaaacctacaaggactagaaaaacaataaaaatagcaaaatatgttaaaagtagtgccatgtaattcctcctttatttgattacatatataactatacactatgtatttaattttgtcaacacttttttgcaaaaaaaatagacggattttaaatccgtctaaatttatattctatttgaatactccccaggcaacgccaggtatttgattaggtggaacaccttgacaagttctaacagggcaatatactctgttaccgttgtaagcattataacctatccaaatgtgacctgcttggatacaaacttcgtcatatacaattgtagcccctgccggtaagttaccgcctactggagcatttaagaatggagaacctattctagttactataggttggttaccattgacaaatgttgcattttccggtttataccaagttccgtactggttctttttccaagaacctgtaactggtctagttgccggtgtacttgcgctacttgttttaccatctttaactactgtagaacttgaagttcctttatccatgtagtttttaatttgtttaatgaaataatcttttaatttattcattattgcttgtgatggtcttccttgtgttactggattaaatcctgtatgaagaaccatagaacggtgaggacaggcagttggtacaaattccatatgcaatcttacagttttacggttaggagtaagaccccattctttaaatttctctgctgtaaattggaatactgcttgttcatttttaaggaattgagcatcactagcactcattgattgacagacttcaatacctgcaaatctaaagttacctgagtttgctcctgttccatccgattattcaataaaagacgtaactcctttaccggttctcttatgaactccttatagtttcctataagactagactatatcttcaccctaattttgttaggggttctccatttcgatttaagggattctcacccactccattaacttgagccctactcctattgacgatttatttttattggcactcgtccgagggatagtcgttgaaccttaatattgtttccaaatgtatccgtaggctgtttttctctctcctttgatacatcttcctatattaccacttcttttattagaaatacctaagaactctaaagcctcttgagctgtgtaaaagacattcaataaattaccttctaagtcatactgagctatattataatttatttcattttttaatcctgtctttattgcatgttctctgttctcggaattagaaacccattctaaatttcctacactattatcatttttaccatttaaatggttaacttgttctttattatcaggattaggtataaaagccatagcaactaaacgatgtattttaggtgaatggtatcgtaaccttacaaacaagtaacccttgttatttttttgaagttttaactttttaggctctttacctttataagatattacttctcctttatcagtaatagtgtaattttcatatatttctaatccaggtatttcatttaatttcttttccataataacatctcctttacttaagtatataggaaagttattatgttgtcaagtagttttttaaaacaatattcttggatgctgattagcatagcttgatagccttagcctcccagtcaattaaaagaactttcattatacattactgtataacagggcaatttatttacccgtgtgccaagcaatttgattcttagcatctattgcttcccatacataaccttcagagccgtagtaatgagcaataccattagcgtatctagcataacctgcattagctaatgaattctcgtattgttgtcctgaagaacgacctgcatcgttgtgtattaccattccttcaggttttttaccacgtttatccattgtatagttaatgtgattcttagaaacttttagtgttgctttctttttaggtgcaggcgttttacttgcgcttttcttagctgtttcttttttaacagtagttcctgcttttacaggtatttcaatgaagtgagttaatccgtaataattatctacacgttttgtaggttttttattagcataaccattccagttttgctctaaaatagtaaatgtagaagtattacctccatcatatacaatacctatgtgaccccactgttcataactaccggatgtaaataccgcaatccaaccttttttaggtacagtagaaggtttattttcatgtattttaaatccagtaccataactctgtttaatttggtctttagcattaccccaagttctaactttattatctgttaaccataaaacatagtctgtaataaggtcttgacactgagcgtgatagtaaccatctgcatcaatggctcctgcttccattacaccaaatgatgggtcataacttgtagcttttttaactctgtaagggctatctactgttccttttgcataagcatctaaacgtttatttatttctgcttgagtcttagccattacttaacttcctcctctgcaaatactttaccatgttcctcggtatcttcttcatcttgagaaggtgctgaaccaccatcaatttcatcttcaatagcaggtacttcatcactatcatctgtgtcaggttctgcattgttttcgtagctgtctatctcaaaagtactagtgttatttgcatttgcttgccattgaacgaattcattagggtctttactatcacgaggtttaagatagtctgtttgaacaatatcactatctttaagacctttagtattattatcaacaataatacctaaacctgctaatagtgttagtatagaacctacaatatttacaccttgctcaatttgagctgagtagtctaaaccgaaagcacctataatttggttagcaaataatgctactgctgatataattgctacccaaaatgttttgctcttagttcttgtgctaaggtttattcctccaacaactttaggttgtttagtttcattagccattaaaaaaccgacctttctattatatttatttctaacaataatataacagtaggtcggtcatgtttatctatattaatttaacacttactcattaatttggtttagttttttgataacttcagacatttgtttgttatctaaatcttctaatttagtttcaggaagtagctctaacttatcccaaacttcttctttattagatactttattattaataattgccttaccaactaaactttccgtataatataattgttttgctgatgccatttgtatctctccttttaaatatgtaaagtatatagctagtatcgtatcctaggaacaaacacttgcgctatatactcaatgaaatcctaccctcattcgaggacacagcaaaccggttcgtcaaccgcacatatgaattctcagatttcatttatgtaaaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttaaaacgacccatacgagactcgaactcgtactctctgccgtgacagggcagtgtgttaaccagttacaccaatgagccaaaattataatgctataccctaaccttaccttaatgtatagcaggtttttatataagctcgaagcaacgattattaccactcataacaactatatattaagtgaaaggaggtgaaatgaacaaaacgtggtaattggtacttatataggaaatatgtataatctacaaggagtaagttattggttcataaaggagtgtgaacaataaatacatgaaagagtgaaagtttactccctgtagattctttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtaaaacggtaataagtttattaaataatgtgatattaacatattagttaataactttcacatggtcgaagaaaagtaaatttatttgattaccaaattatttttatcaaatatagctcttttgaacctgtagatttatgctacttatactgataacctctattatctaacacatttctgtgctccaactacagttagtcgttacagcgtatctttctaggattccgctaagaccctaaaaagaaattaaaccctagccgttatcatactctacagaccttataagtaagtaccaagtataccaatcgtatttaacaatactaatgacgacccatcctaccgatatatctccgataggttttgattcgtttgattatcttgtaccttatgactaccaaatcattattcagtcactatgctcagatatttagttgtattatttatatattaattataacataatttttattacttgtcaagttaatttcaaaaaaattatagaagtagggacgtttacctacttctatttaatttacacaaggatgataacattgttattgttttatactggaaaacaatgtaataaaaacagtgatgtgtaaggtatttgttttattgttaattatattatagcatatactgatacctttgtcaagttaatttaatactttttttaaaacattagttatcttttgttagttcctcctgaatagcatcccatcttctttctgcttcactacgattatcttctatatgttttgtagttttacaacatttgatacaatatatatctttgatatgaccttcttctcttttatttgctctttttcttggtactttgaatacatttccacattctttacatattaaacttgagtaaaacattttttgtcttttcataattaatcaattccttttctcttttatttgataatttaactatatactatattgataaataagtcaacagttttctaaaaataatttaaattattttgaagaatactttaatatcaagggttacaagagaaaaagtacgtatttagaaaataaggagtactcctattatatataattatattctgatatagagtaataaataatattaaatatataattataattaataaggttgggaaaattgatataaacataactgatactgcttatagatactcagtataaaagtaaaatcccttagtatcagtacttacaggcaaaaaagtacgtatttagaaaataaggagctctcctattatagttatatatatttattactattattaattactatttaaatatataattataattaacaatgttagaaagtcaacaatagtataaataaaaaagtgactacttaaagtcactcaataattagaatactattttaaaagattctattctgtttggattaatatatacttgaggtgaagttatagcactttcagtatatacttttatagaggtttcatccattcctcttaacatataatctatatcttgcctattgtaactcttttcatcagtagatactaaaaagtatttagctccacttgacattgttatttcaatatgttttgacatctacaatctctcctatgcaaatttgttaaagacaaaggataatatagctcctagaacaagtaaaagaaccttctcagttgtatcctttttcttagtatccttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaatgggctagtgcatctttaaactctaacttaaggatatccttatatttagtcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttttctatagatagaataacctaaagacgttgtaacaccactaagtataaaataatagaaacaaaaaagaggtatagacagaaaaaaagatacgataatcattgttaaacacctatttctttttgacctattatttctagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttactcaataagaccgagtgtagttatgacatactttatctttggtggtattgtttctaatgtcgcacttactgtaacagataagttcttactgaagaaagaagaccccctacctgaatatgttcttaaaaaagtagagataaatgataaagaaataagaataatcaagaaaataatagaaagtaattatggtataacagcagaagagataaaagttagggctaaagcacaaagaagagtagaggaagatagtaaaaaggaagattacaatgaaaacaaagaaagaaattaaagaacaaaggaaagaacttaaggatggtgctacatctgtttctttagtaaaaaagggagataagagaatagctagccctagtagaatttgtagtctatgtggtcagcagttatcaggtatgaattacactaaaggaaaagcattatcaaaagttaatcattttcatttacagtattctaagtatatttattttgatatttgcgcagatatcaacaattgttataaaaatttaagaaaacgaggtgaaatggattgagtgcagaaaatattagagatataattaacaagaaaaagttagaagaagaggatacaagaaaatatatagctgatgggtttatgaatggtatcggtaaattaatgtacgaatttaataagaaagtagataacaaagaaatagaagttaaagacccgaatgatttatacaaattatttgtgatattctctcaaatgcaaaatatggtcaatgaaacttctgaaggaggagcaatacctcaactatctagacctcaacaggaattatttgatgagattacaacagaagatagtaatggagaatctacagttgatttacagaagatatcagaaatgtcagcggaagatattacagcaatgatttctgaaaaggaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgctaaatccttctacctatatgcttaagtatcatacactgagagggcatcctataacttttagtattcctaatagagatagaagtaaagcacaggctcatagaccttggcaaactaggattgtaaatgatactcatcctaataaggctgtaataaaatcacgtcagttaggtcttagtgaaatgggtgtaatggaaatggttcattttgcagatatgcatagttatgctaatgcaaagtgtctgtatacattccctacaaacgaacaaatgaaaaaatttgttcagtcacgtttgaaccctgttttagagaaagaatattttagagacattgttgattgggataaagactcgttaggttttaaaaagataagaaactctagtttattctttagaacaagttctaaagcaagtactgtagagggtgtggatattgactatttatctttagatgagtatgacagggtaaacttattagcagaatcgtctgcattagaatcaatgtcttcatcaccttttaagattgtgagaagatggagcacaccttctgtacctgggatgggtatacacaaattataccaacaatcagaccagtggtattacggtcatagatgtcaacattgtgattacttaaatgaaatgagttataatgattacaaccctgataatcttgaagaaagtggaaatatgttatgtgttaatcctgaaggtgtagatgagcaagctaaaacagtacagaatggcagttaccaatttgtttgtcaaaaatgtggtaaaccactagatagatggtataatggtgagtggcattgtaagtaccctgagcgtacaaaaggtaataaaggggtacgaggatacctaataacacaaatgaacgctgtatggatttctgctgatgaattaaaagagaaagaaatgaatacagaatctaagcaagcattctacaactatattttaggttatccttttgaagatgttaaacttagagttaatgaagaagatgtttatggtaacaaatcacctattgcagaaacacaattaatgaaacgagatagatattctcatatagctattggtatagattggggaaatactcactggataactgttcatggtatgttacctaatggtaaggtagacttaatacgattattctctgttaaaaaaatgacaagacctgatttagttgaagcagatttagaaaaaataatttgggaaatatctaagtacgaccctgatattataattgcagataacggggactcaggtaataatgttttaaaactcattaatcattttggaaaagataaagtatttggatgtacttataaatcttctcctaaatctaccggacaattaagacctgaatttaatgagaacaataatagggttacagtggataaattaatgcagaataaaagatatgtacaagcacttaagacaaaggatataagtgtttatagtacagtagatgatgatttaaaaactttcttaaaacattggcagaatgttgttattatggatgaagaagatgaaaaaactggagaaatgtaccaagttatcaaacgtaaaggtgacgaccactatgcacaagcaagtgtctacgcctatataggattaacaagaataaaagaacttcttaaagaaggaaacggtacaagctttggttctacatttgtttctactgattacaatcaagaaggaaataaacaattctactttgatgaatagaggtgaaatagacttgacagataaattattttatggtacaattagtaatgaagaaattaataaaagtgtattgaatttgttattgggtgaggaattatccttagattatgtttctaaaaatagtgatactttagatgttaaatatgaacatgtttataaatctctaggattcgataatttctttgattgttttttatatgctaatagagagcctgaaatagtccataaaggtggagataaaaatcttggtggactaaataaggttaaacgtactgttattcgtaatggtaaagaaatggaaatgacagtttacgaagatggtaataaagagaacgatagtaaagaaaaacaagaaggaaaagaagaagttagtagaagtgcagtaggagcaagggctatttctaatggtgaagaaggaaaggtaaaccctaaaaaggtagcaaattcattatctaatttaagtaaaaaaggtgtagatgtatcacatattaatacaaactcatcattgtataaagagtttgttgatgataacggtgatacattaggaattacatcttttaaacgaactgaaaatgatataatattagaatcttatgcaagttcacatgattcagatggtgtaggagcaagagctattatggaattattacgtttaagtattaaggaaaataaaaatgcagttgtgtatgatatagaattacctgaagcagtagagtatttaaaaactttaggatttaaacctaataaagatggatacatcttaagaaaaaaagatgtaaaacaattcttaggtgattatagtgattttatttagcactatagtcatctattctattgtatttattctatatattgtattaaaaacaatttatataaagtctaatatgagtagaatagataacacaactgaattattaaaaatattacaggaagatattgaaggtaagataaaaaaggaaggaagaaataaatgactttagaagaaaataaattaacattagaagaatcaataactccacttagcaaagaggagaaagaagatagtattaaagaatttagcagtttattatgtgaaatggtaaatagactatataagtcttataatgtatttagacaagaccctatggatgaaactcaacgtctagatggctctttaatggtctttcaaagtagattaaatgaccctttaacaggagatttacatgataagatgtataaacttgctttttcaaaacgtattgatattttcgaagctaataagcaatttagaaaagatgtagaagcaggtaaagcaattgagttaggtgatgtagctattatagatacagcattaagtaacatcctttcaggcaatgagttccaaggaagtatttcatttatgcttagaaaagactttgaagaaaaagaacgaattagaaaagaagaagaagagaaacttaataacttataaaagggaagaattatgagactatataaaatgaggtatcataattgaaaaagaaaccacaaggcaatgaggtaatcataaccataataacggttatgatagcagtatttgtagtcattatgaccatattttttaataaatatcaagatgctaaagaagataaagatagatatcaaagattagtagagatttataaaaaagcagatgataatgatggtgagactaaaaagaaatatgttaaaagattaaataaggctgaagaagaacttaaaaaagtaaaaaaagaaacaaattataaagattataataagaagtcaagtaaagaaagacaaaaagaagataaagaaactagagagaaaatatatgatgtaactggtgatgatgacttaatattagtaaaaaataatattgagtttagtgataaagtagacaagcccgaaatacttattagtgaagatggaattggtacgataactgttcctgtagatagtgggtatgaaaaacaaacagtaggttctattattactagtgtattaggttctcctttcctatcacctggttcaaatagtatagatggtttaagtgttattaacgataatgtttatccaaatacagtagatagcatagtagaagatacaaaaccttctattaacttaccaacggataatcctattataacaaatccagttgaaccaactataccttcagatattatacctcctattgataatccttcagttccgatatctcctgagaacccaggagataataatcaaggaaatacagataatccaaatcctccccctccagggtacacagatgaagatggtggaagaggctccggtggtggaggaaattctgaaccaccatcaacggaagaaccttcggataatggtaacaccggaggaggagattgggaagaaaaacctgacccaggagaagaaccttcagataatggtaatacaggaggaaatggtggagaagttacgcctgaacctgaacctgaacctgaacctgaacctgaacctgaacctgaacctgaacctgaaccatctgaaccgtctgacaatcctgatgaaaatggaggatgggaaactgaaccaactgaacctgagtcaccttcagagccggacgataaagtggacgaagaagataaaaatgaagatactacagatgataaacagcccactgaacaaccggacgataacaacatagataatgaagataaaactgaagaggagtaattactcctcttttttgtttgctatattaaataagagctaaatataaaaaaattgaacattacggtggtgaaaactttgttaggaatgaatattataacgtcactatcagtagtatttacttgtttaagtcttttaactttaatgatttttgttcatagtaagttctctagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttactataagttttataggtgcaatacttggaggaatttggtacaagatgatgaaaattattaaaaagagtaactttaaagataaaaaataaaaaagacggtgaataggttgatattctctaaagataaaaaatgggatgaagcaaaagatttcatcaaaggtcaaggtatgcaagataattggatagagattgtagattattatagacagataggtggaaaacacgtagctgtttttattgctttaaacaaagtaaaatacatgattctagaagcaacaaaagacaataaggtaatattagtagataaagataataatatactattagaagattatgatattgttatggaaagtaagaagatgttttattacattgaagaaccgttcgaggttaaaataaatatccctcaacatattagagatgtaacttataataatactgttgtattaactacagtaagagggagtagaggtgactagtaattggcagatttatttaagcaattcagattaggtaaagactatggtaataatagtaccattgctcaagttcctattgatgaaggattacaagctaacattaaaaaaatagaacaagacaataaagagtatcaagatttaactaagtctttatacggacagcaacaggcttatgcagagccatttatagaaatgatggatacgaatcctgaatttagagataagagaagttacatgaagaacgaacataacttacatgatgttttgaaaaagtttggtaataaccctatccttaatgctatcatacttacacgttcaaatcaagtagctatgtattgtcaacctgcaagatattcagagaaaggtttaggttttgaggtaagattaagagacctagatgcggaacccggtagaaaagaaaaagaagaaatgaaacgtatagaagattttattgttaatacaggtaaagataaagatgtagatagagattcatttcaaactttctgtaagaaaattgttagagatacttacatctatgaccaagttaactttgaaaaagtatttaataagaataataaaactaaattagaaaaattcatagcagtagacccttctactattttttatgcaacagataaaaaaggtaaaattattaagggtggtaagagatttgttcaagtagtagataaaagagtagtagctagttttacttctagagagttagctatgggtataagaaaccctagaactgaattatcttcttcaggatatggattatcagaagtagagatagctatgaaagagtttattgcctacaataacactgaatcatttaatgatagattcttctcccacggtggtactactagaggtattttacagatacgttcagaccaacaacaatcacaacatgcattagagaactttaagcgtgaatggaaatctagtttatcaggtatcaacggttcatggcaaataccagtggtaatggcagatgatattaaatttgtcaatatgacaccaactgctaatgatatgcaatttgagaaatggttaaattaccttatcaatattatatctgctttatatggtattgaccctgcagaaattggtttccctaatagaggaggagctacaggttctaaaggtggttctactttaaatgaggctgacccgggtaaaaaacaacaacaatctcaaaataaaggtttacaacctttacttagatttattgaagacttagttaatagacatattatatcagaatatggagataagtatacattccaattcgtaggtggagatactaagagtgctactgataaacttaatattcttaaactagagactcaaatatttaaaacagttaatgaggctagagaagagcaaggtaagaaacctattgaaggtggagacattattctagatgcttcattcttacaaggaacagcccaattacaacaagataaacaatataatgatggtaaacaaaaagaacgtttacaaatgatgatgagtttactagaaggagacaatgatgattctgaagaagggcaatcaacagattctagtaatgatgataaagagataggaacagatgcacaaataaaaggtgacgataatgtttatcgtactcaaacatctaataaaggtcaaggaagaaaaggagaaaaatcttctgactttaaacattaattaataagcctagaataaatctaggctttgtttatttttttcgtaatttaattttgataaatgtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatcgtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgacgaaaatgttgttaagatgcttgatttagctgagaaattagaaaaatcaggtagtggaagacgtttaggtttttctattgaaggtgcagttaaaaaacgtaatataaatgacaatcgagttattgatgaagttatgataaccggagttgcattagttaaaaaccctgctaatcctgaagcaacatgggaaagctttatgaaatcatttttaactggtcatggtacatcacctgacactcaagttgatgcaggagctttaagaaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagagcaagtagcagaaacaactgaagaacctgctaaagaacctgaaaaagtatctgaggaagatgctaaagaagcacaagagcaaggtgaaaaagttgaatctgaagaggtagcagaaggcaatgaagatgaggaagttgaaaaatcagctaaagaatcaaaagaccctgtagaccaaaaagatactaagacagaaaataaagacaacgagaaacgtaaaaataaaaaagataaaaaagaagattctgacgatgaagataaagatactgacgatgataaagataagaaagaagataagaaggaaaaaacttctaaatcaatttctgatgaagatatcacaacagtatttaaatctatcttaacatcttttgaaaacttaaataaagagaaagaaaactttgctactaaagaagatttaagtgaagttagtaaatctattaatgagttatcagcaaaaatttctgaaatccaagctgaagatgtttctaaatcagtagacactgatgaagaagctgtagaaaaatcagtaacatctacaaacggagagcaagaaaaagtagaaggttacgtttctaaatcagtagacactgaagaacaagctgaaactggtgaagcaaaatcagaagaagctgaagaagtacaagaagataacacatttaaaggattaagtcaagaagaacgaactaagttcatggattcttacaaagcacaagctaaagaccctagagcttctaaacatgacttacaatcagcttaccaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagacttaatcttctatcgtgatatctcacgccgtcctgctcaatctacagtagtaaaatacgaccaatatttacgtcatggtaacgtaggtcactctcgtttcgttaaagaaatcggagtagcaccagtatctgacccaaatatccgtcaaaaaactgtatcaatgaaatacgtttctgatactaaaaatatgtcaattgcatcaggtttagtaaataacattgctgacccatcacaaatccttacagaagatgctatcgcagttgttgcaaaaacaattgagtgggcttcattctacggtgacgcttcattaacttctgaagttgaaggtgaaggtctagagtttgatggtttagctaaattaattgacaaaaataacgtaattaacgctaaaggtaatcaattaactgagaaacacttaaatgaggcggcggtacgtatcggtaaaggtttcggtacagctacagatgcttacatgcctatcggtgtacacgcagacttcgttaactcaatcttaggtcgtcaaatgcaattaatgcaagacaacagcggtaacgttaacactggttacagcgtaaatggtttctactcatctcgtggattcattaaattacatggttctacagtaatggaaaatgaactaatcttagatgaatcattacaaccattaccaaatgctccacaacctgctaaagttacagctactgttgaaactaagcaaaaaggtgcttttgaaaatgaagaagaccgtgcaggattatcatataaagtagtagttaactcagatgacgctcaatcagctccttctgaagaagtaacagctacagtatctaacgtagacgatggtgttaaactttcaattaatgttaacgctatgtaccaacaacaaccacaattcgtttctatctaccgtcaaggtaaagaaacaggtatgtacttcctaatcaaacgtgtaccagttaaagatgcacaagaagacggaacaatcgtattcgtagataagaacgaaacattgcctgaaacagcagacgtatttgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggatttaataaatatgttatactataagaaactattagataaaaaaatggctactgtttatggtacagtggagattgacaaagatggagtagtcaaaggattaactaaagaacaagaaaaagaatttgccaatgttccaggttttgaatttgaagaagaaaagaaaactactagaaaacaatcagcttctactagtaaagaagaagagcctaaggaagaggaaaagaaagcctctactagaaaaactacaaatactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacacatagatgtaagtgagatagataatttaacattagctgattatggatggtcaccggatgcagttaaagcatatatgttcggtattgtagttcaaaatcctgatacaggacagcctatgggtgacgagttctataaccatatattggaaagagcggtaggtaaagctgaaagagcattagatatatctatactacctgacactcaacatgagatgagagattatcatgagacagagtttaatagttacatgtttgtacatgcttacagaaaacctatattacaggtagagaacttacagctacagtttaatggtagacctatatataaataccctgctaactggtggaaagtagagcatctagcaggacatgttcaattattccctacagcacttatgcaaacaggacaatcaatgtcatacgatgcagtattcaatggataccctcaattagcaggtgtatacccaccatcaggagcaacatttgcacctcaaatgatacgattagaatatgtatcaggtatgcttccacgtaaaaaagcaggaagaaataaaccttgggaaatgccccctgagttagaacagttagttataaaatatgcattgaaagaaatataccaagtatggggtaacttaattattggtgccggtattgctaataaaacattagaagtagacggtattacagagacaataggtactactcaatcagctatgtatggtggagctagtgctcagatacttcaaataaatgaagatataaaagaactattagatggtttaagagcttactttggatataatatgataggattataaggagggttagaaaatggaaaaaccgtatatgataggagctaactctaaccctaatgttattaataagtcaacaacatatactactacaacacaagcagatgaacaagataaacctaagtatactactagactagagtttgatacgattgacatgattaggtttattaatgaccgaggtataaaagtactatgggaagaagcatatttctgtccttgtcttaatcctgatacaggacatcctagagtagattgccctagatgtcatggtaaaggtattgcatatctacctcctaaagagacgataatggcaatacagtctcaagagaaaggaactaaccagttagatataggtatattagatacaggtactgcaataggtaccactcaattagaaaagagaatttcctatagagacaggtttactgttcctgaggtattgatgccccaacaaatgatttattttgtgaataaagatagaattaaaaaaggtatacctttatactacgatgtaaaagaaataacttatatagccactcaagacggtacagtctatgaagaagattatgaaatcaagaataatagattgtatttaaatgaaaaatatgagaatcatacagtaactttaaagatacttatgactttaagatatgtagtatcagatatactaaaagaaagtcgttatcaatatactaagtttaatcaacctaaatcaaaatttgaaaacttacctcaaaaattacttcttaaaagggaagatgtcattgtactacaagacccttataaagttaatgatggtatagaagaagacctagaaattcaagtagatgaccctaaggcttcggcatctaatcctagtaatttaggtggattcttcggaggtgcatttaaataatgccagttcatggaaagagacctaatttatttaaaaataaaaactataagcaggtaggtaagagaacaattgatggtatgcgttcagaagttcttgataaattacaagcaacagcacagcaagtagagaatactagtattaaacgtatgcctacttatctacaaataacagagaaaaagcttgaaaaagaaggagtagtagaccttaaaaaagcttttgctcactcatctaaaaagaaaactagtaaagatggcggatggtatttaactgtaccaatccgcatcaaaactagtagaatgaataacagtacttatcaagatatgagaactttaaaagtagataaaggaacaggttcagtttcgaagataactgattacctagaaggacgtaggaagaatgtaagccacccttcaatgaagcctgaacctatgactcataatatgactaaagttaaaagaggaaagcaatcttcttactttatatttagaactgtttctagtaagtcacctgctagttcttggatacttaacagagataaagttaatgaagataacttctctaaaacaactctaaaaactgttaagcaattaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgtggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagatactttagtcgaatcttctacagcaataagagaagatgataagttagtttttactgtttctaaaccaataggagagttaataaaggtagaagatatagagtttgctaaatacgataatcttcaggttgaaggtaataaggtatcatttaagtatcaaacaaatgaagattatgagaactacaatgctaacattatatttaccgaaaagaaaaatgattctaaaggtttagtaaaaggattcacagttgaagaacaagtaacagttgtaggtctttcatttaatgtagacgttgcaagatgtttggatgctgtactgaaaatgattttaatatctatgagagatagtatagaagagcaacaaacattccaattacagaatttgtcttttggtgatattgcaccaataatagaagatggtgactcaatgatttttggtagaccaacaattattaagtacacaagttctctagatttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaatatgagggattcacaagtagcaggatttaaagcttatatggaaggtagtcattatttgtttagtgagcaagaattcttaccatcattagagaagtatctaggtaggaaattagatatataataacattcagataaggagaattaaatatggcagtagaaccattcccaagaagacctattacccgtcctcatgcatctattgaagtagatacttcaggtaycggtggctcagcaggttcaagtgaaaaagtattttgcttaatcggtcaggctgaaggcggagaaccaaatacagtttatgaattacgtaactatkcacaagctaaacgtttattccgttcaggagaattacttgatgcaatagaattagcatggggttctaaccctaactatacagcaggacgtattttagctatgcgtatagaagatgctaaacctgcttcagcggaaattggcggattaaaaataacatctaaaatctacggtaatgttgctaacaacattcaagtaggattagaaaagaatacactaagtgattcattacgtttaagagtaatattccaagatgaccgtttcaatgaggtttatgataatatcggtaatatcttcacaatcaagtacaaaggagaagaagctaacgcaactttctctgtagaacatgatgaagaaactcaaaaagcaagtcgtttagtattaaaagttggagaccaagaagttaagtcatatgatttaactggtggagcttatgactacactaatgctattattacagacattaatcaattacctgatttcgaagctaaattatcacctttcggagataagaacttagaatctagcaaattagataaaattgaaaatgcaaatataaaagataaagctgtatatgtaaaagcagtttttggtgacttagaaaaacaaacagcttacaatggtatcgtatctttcgagcaacttaatgcagaaggagaagtaccaagtaatgtagaggttgaagcaggagaagaatcagctacagtaactgctacttcacctattaaaactattgaaccgtttgagttaactaagttaaaaggcggtactaatggtgaaccacctgctacatgggcagacaagttagataaatttgcacatgaaggcggatactacattgttccattatcatctaaacaatcagttcatgcagaggtagcttcttttgttaaagaacgttctgatgcaggagaaccaatgagagctattgttggtggaggattcaatgaatctaaagaacaattgttcgttagacaagcatcattatctaatccacgagtatcattagtagctaactcaggtacttttgttatggatgatggacgtaaaaaccacgtacctgcttacatggtagccgtagctctaggtggtcttgcaagtggtttagaaatcggtgaatcaatcacattcaaaccactacgtgtaagttcattagaccaaatctatgagtcaatagacttagatgaattaaatgaaaatggtattattagtatagagtttgttcgtaaccgtactaatacattcttcagaatcgttgacgatgtaactacattcaacgataaatcagacccagttaaggctgaaatggctgttggggaagctaatgacttcttagtaagtgagcttaaagttcaacttgaagaccggtttattggtactcgtactattaatacaagtgcttcaatcattaaagactttatccaatcttacttgggtcgtaagaaacgtgataatgaaattcaagacttccctgctgaagacgtacaagttattgttgaaggtaacgaagcaagaatttcaatgacagtttacccaatcagaatcttcaagaaaatctctgttagcttggtttacaagcaacagacattacaagcctagtctaggtgacggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagacatcattgatattttagtagtagataacttaacaaaacaagttattatttcatatcatggttgtagtgctaataactacaacgagacataacttttttctgctgtgtctctgtacagtgatgtataacaaaaaaacccttctaattcatgggaacccttaacagataatgctgaaggcaatcatgagccaagcctagtaaagtactaggaaggtgcaacgactagagaaaagatagtttactgttataggcagtaaatgaaaactgagtatcgtacatctaagtagatggaaatggagggattcctaaagtaacgtttaggaatgtgatatagtctagtctatatggaaacatatagaaggtaagaagtaacgactcttatcgtaataataacaggcagaccaatgaaatcgtaactgaagaaattgagtagaagaatgctcctttaactagaaatagttatagcaaatccctttaattcatgggaacccttaacagataatgctgaaggcaatcatgagccaagcctagtaaagtactaggaaggtgcaacgactagtcagaatgacgtacatctaagcagatggaaataggggacaccttcaatattaaggtgaagatatagtctgaactatatagaaatatatagaaggttcaagagtagcgttttgaatcgtaacaaatttgtttcttatttaacagctagtgataaagcccgtacctaaagggtttaaagacctaacaataaaagttaggtcttttttattgacatataactaacgatatggtaacattaaaatataatattaaagaggtgttaagaatggataaaaaaataataggattaaatacaaaaacattagaagagaaggtttttactactataaaagaagcagaaaaagaaattgaattaagaggtaccgttaaaagatgtttaaataatgaaattaagtctactaaaggatggttatttaggtatgaaaatgaagattttcctgagaaggcaagaacaataacagacaaaagaattaaggttgttgttttaagtaaagaacaggaacaaataaagttacctcttgagatggctaaaaatttatatggaatacctaaacctatgattattgaagctattcaatataaaaggaaaattaatggctactctgttagaagagctacaaaagaagagcaaaagattacattatctaacattagttatatagactatataaaaacagttaataacccaaacaatattaaaattattaaaaataagggttcttttggtgaacagttagttaagacaatattagactataataatatagaatataaaagggaatattcttttaagaatgaattagggacaatacaaagaatggattttttagcagtagtagataataaaaaatactgtattgaatatatgggtgagcaacattatgtagagaaaggtaataagtggggctcgttagaaaagagacaatttctagattctataaagaaaaaatactgttacgaaaatgggatatactatattgatatcagttataaaaacagtgatttagagagtgtattcaatgttattaataaacacataccaggtattaaaaaaccaaataaatctattattgatattggtgtgacaataaatatagaagaaatgttagaatactataaggagcatactaaaaaagaaacagcttataaatatggagtaaaggaacataatattgataacttattagtaaatttaaactatgaaagcaaaagaaaacctaaagatataatacaagtatataagagagatgaaaaaatatttgagggcacttataatgaaattaaggatgaatttaattttactatgagtaatgttttgaaatgtttaaatggagaactagataaaacatcacaacattactttaaatataaagattcagaaaaagatagagttagacaactaaagactaaagaaagacataataaaagaggaacagtaagaggaagtagtaacaaggatgtcgttctcaaggacatatattcaggagaggaaactgtatattcttctattaaggagtgtcacgaaataacaggtctaaacaaagacaaattatacaagttatttaatccaaataaaagtaaacaaattatagacaaatatataggtaaaagctatggcggtgaataccctataactgtagaagaggctctaaatataattaacccttgaccagtatcaagggttatgttattataataaataagaagggattatattgacaaacaaaagaaaaacaataggtaaaataagtaactcaagagcaacatggaatattaatccggtaactaaagttaaaaaagataaaacaaaatattctagaaaaaataaacataaaggtcttgacaattataattaactaaggtatattattagtataacaaaaaaaggagatgggtatatgagtacattttggtcagaaagaagaacaactaataaagataggcaagttaaaaaacattatactcaaatgagtatgtatgaaagaaagaaatgtgtagagttattacaagagacaattactgaaaatagaattattaattttacacgacatagtgcaaaaaaggttaaaggtaaaccaacaacaaatatacctaaattaataggttttatttttaaaaataagtttgcctacgaaaatatcatagagtacaataacacagattataatggtaatattgagaggagaattgttgttaaacatcctaaagttataactgtagaaggaaaacctagctatcagtttttgacaattagtcttgaagatgctagagttattacggtgtggtataacagtgtagatgatacacatagaacactagatttaaattattatagtaaagacttgacaattcaataaggaggtattataatgggtataacaatagtaaatagttattttattctgtctagcattttcctcatcatattaaccatattaaatggtaagggtacagttacaagggaatcattaactatgagtaaaatattagtagtaataacatcaattcaatttttagcatgtttaattattaatggtatttattggtcactaaaatttatgtagtagaactagaataaaagtattgacaaattaaaactaataaattataataaaggtataacaaattaaaggagaagatataaaatgtcacaagataaattaagagcaatttacacagaaatgaaagtagaattacacaaatttcctaaagaggtagatataacaagtaaatcaactgcaattgcaatcaatcagattttagataaattcaaaacattaacagaacaagcaggaaagattactagaaaatatttagaaggtcaagaaatattaactattgattatgagtattatgattcattacaagaatactatatttacctacttagaaatagtgaaaagattgaacaaagtttacaagaaattactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagaaaaaaaagatgttagtaaaatgacaccggaagaaatagataaattaaaatatcaagacaaacaagaaaaagaacaagttattaacaaagttattaaaggcgttaatgatacttgggaaaaagaatataactttgaagaactagacttaagatttaaagttaagattaaattacctaatgcacgagaacaaggtaatatctttgcgttacgttctgcttacttaggtggtatggatatgtaccaaacagaccaagtgattagagcatatcaaatgttagctaccttacaggaagtaggtattgaagttcctaaggaattccaagaccctgacgatatttataacttatatcctttaactgttatgtatgaagattggttaggattcttaaactcctttcgttactaatagtatagaaacattagataaagatatagaacgattgggcggtatggaatcaattgttaaacaacctttatctagaaatctatgggctattatgaaagagtttaatgttttacctaccgagcaaagatttaaggacttagacgattatcagatagagtttattattgggaatatgaacagagatgtttatgaacataacaaacaacttaaacaagctcaaaaaggtggaaaattcgatagtcaattcgaagatgatgatagtagttggtggaatgaatctcatgaagactttgacccagtacctgatttcttagatgctgatgatttagcacaacaggtggaagctaaattatccgatagagataaggaagaaagagctaagagaaacgatgcggagttaaatgatgaaacagaaggacttactacacaacatctagctatgatggaatacatcagacagaaacaacaagaattagatgatgaagtaggaaatggtaagactagtgaagaggatgctactatatcacaagatagcgttaataaagcactagaagacctagatgatgactggtatatgtaaagggtggtaggtgatactaccatccttatttttttaaaatggatggtgaataatgatggcaatgaatgatgattatagattggtcttgtccggtgatagttcggatttagagaatagtctgaaggcaatagaactttatatggattctttagagtctaagaatattgatgctcctttagataatttcttaaaaaaattaaaagtaattgctaaagaagttaaaaatgtacagaacgcaatggataaacaagatggtaaatctgttatatcttctaaagacatggatgaatctattaaatccactcaatctgctacaaagaatataaatgaattaaagaaagctttagatgaccttcaaaaagagaatatatctaaaggtattgcacctgaccctgaagttgaaaaagcatatgctaagatgggtaaagttgtagatgaaactcaagaaaaacttgagaaaatgtcttcacaaaaaataggttctgatgctagtattcaaaatagaattaaggaaatgaaaaccttaaatcaagtaactgaagaatacaataaaataagtaaagattctagcgcaactaaagattatacaaaacgattaagagctaatcgtaatatgactagaggttacatggagcgttcagaaggaacaggacgattaacatatgaccaaggtgcacgagttagaagtgagctaggtaaaataagttcttatgagagccaaagaaaacaaaaccaacgtaatttaggacaagcaagagagcaatatagcaactatagaaatcaacaacaagacttgactaaacgtagagctagcggtcaaattaataaggaacaatatgaacaagagttagcttctattaaacaggaaatgaaagctagagaagaacttatatctaactatgagaaattaggagcagaacttgataaaacagttcagtattataagggttcagttcaaaaggatttccaatctagagatgtagaccaacaacgaggaacatttggtagaatggttcaagaacgtttgccatctattggttctcatgctatgatgggtactacagctatggctacaggtttatacatgaagggtgcctcactaagtgaaactaatagacctatggttacatcattaggtcaaaattccgataatatggatatagattctgtaagaaatgcatatggagacttgtcaattgataacaaattaggttataatagtactgacatgttgaaaatggctacttcatatgaagcatcagtaggacataaaagtgatgaggacacaatggcaggaactaaacagcttgctattggaggacgttctttaggcattaaagaccaagaagcttatcaagagtctatgggtcaaatcatgcataccggtggagtaaattctgataacatgaaggaaatgcaagatgcattcttaggtggtattaaacaatcaggcatggttggtcgtcaagatgaacaacttaaagcactaggttctatagcggaacaatcaggagaaggaagaactctaactaaagaccaaatgagtaaccttactgccatgcaatctacttttgcagagtcaggaagtaaaggattacaaggtgaacaaggtgccaatgctattaacagtatagaccaaggacttaaaaatggtatgaatagttcttatgctcgtatagcaatgggatggggaacgcaataccaaggtcttgaaggtggatatgatttacaaaaacgtatggatgaaggtatatctaatcctgaaaacttgacagatatggctgatatagctactcaaatgggtggcagtgaaaaagaacaaaaatacctatttaatagaagtatgaaagaaataggcgctaacctaactatggagcaatctgatgaaatatttaaggatgctcaatccggaaaactgtctaaagaagagttagctaagaaagctaagaaaatggaaaaagaaggtaaaaaagaaggagaagataacgccactgattataaagaatctaaatcaggaaaaaatgaccaaaataaatctaagactgatgataaagcagaagatacttatgatatggctcaaccactaagagatgctcatagtgctttagcaggtcttcctgcccctatatatttagctattggtgctataggagcatttacagcttcactaattgcatctgcaagtcaatttggagcaggtcacttaattggtaaaggagccaaaggacttagaaataaatttggtagaaataaaggcggtagctccggtggtaaccctatggcaggtggaatgcctagtggtggtggttcacctaagggtggaggctcacctaaaggtgggggcactcgttctactggaggaaaaatacttgatagcgctaaaggtcttggaggattcctagtaggtggcgcaggatggaaaggtatgtttggcggggagtctaaaggtaaaggctttaaacaaacatctaaagaagcctggtcaggtactagaaaagtatttaatagagataatggtagaaaagccatggataaatctaaagatatagctaaaggtaccggtagtggtcttaaagatatctataatgatagtatatttggtaaagaaagaagacaaaacctaggagaaaaagctaaaggttttggtggcaaagctaagggtctctatggtaagtttgctgataagtttggtgacggaggtaaaaatggtattctttcacaatcaccaaaagcaggtggaagtggcatagggaaacttggaaaacttgcaggtggacttggaaaaggagccggagttttaggtgttgctacgtctgccttatcattaatacctgctttagcttccggagatagtaaagctatcggcggaggaataggctctatgggtggaggaatggcaggtgcatcagcaggagcttctataggagctttatttggtggtgtaggtgcaatacctggagctttaataggtggagctataggttccttcggaggaggagctgttggtgaaaaagtcggagacatggctaaaaaagctaacactaaagaaggatggaacctaggatggactaacggagataaggatggtaagaataaattccaagattctttattaggaaaacctatatctaaagcatggagcggtataacaggtctctttgataatgacgctgaagcatccgaagaagatagtaaagataagaaaaaaggtgttaaaggcgttaaaggagatactaagaagaaagaaaaaatgacagcagaacaacttagagaaaagaataaccaatctgaaactaagaatcttaaaatctatagtgatttacttgacagagctcagaaaattattgagagtgctaaaggtattaatatagatggaggaacttctgatagtggttctgatagtggaggctctgcatctgatgtaggtggagaaggcgcagagaagatgtacaagttccttaaaggaaaaggactatctgataatcaggtaggagctgttatggggaacttacaacaagaatctaatcttgaccctaatgctaagaatgcttctagtggagcatttggtattgctcagtggttaggggctagaaaaacaggattagaaaattttgctaaatctaaaggtaaaaaatctagtgacatggatgttcaattagattacctatggaaagaaatgcagtctgattatgaaagcaataatcttaaaaatgcaggttggagcaaaggtggaagcttagagcagaatacaaaagcatttgctactggatttgaacgtatgggagcaaacgaggctatgatgggtactcgtgttaacaatgctaaggaattcaagaagaaatacggaggctccggtggcggaggtggtggaggagccctatcctctacttaccaagaagctatgagtaatcctgtattaactactggttctaattataggggctctaatgatgcttctaatgcttctacaactaacagaataaccgtcaatgttaatgttcaaggtggaaataatcctgaagaaactggagacattatcggaggaagaattagagaagttctagatagtaacatggatatctttgcaaatgaacataagagaagttattagtaattttgtattgacacaagagtagtatcatagtatactactcttatacatataaaaaataaaaggaagtatgtgtatatgcgtagaataagaagacctaaggtaagaatagaaatagttacagatgataatacatttacattgagatttgaagatacacgagactataatggtgatgagtttggagctaaacttttaggattccaaactaaaaactctatggaagatgatagttcagttttccaaataaatatggcaggagatacttattgggataagctagttatggctaatgatatcataagaatatttattacacctaatgatgaccctaacgataaagaaggaaaacaagaacgacttatccaggtaggtatggtttctcaagtatcaaaagtaggtagttacggtaatgaccaaactcaatttagaataacaggtcaatcttttgtaaaaccttttatgaaatttggattaggcgttattcaggaagttcaagctgtattacctgaagtaggttggcttattgatggtgatggagataatgaagtaaaatttactggtagctcagctcatgaagtaatgactggtattatacgtagatttataccttatatgaaatataactatactgaaaaaacatataatacaattgataactatcttgattatgatgatttaagtagttgggatgagtttgaaaaacttacagaagtttcagcctttactaattttgatgggtcattaaaacagttaatggatatggtaacagctagaccttttaatgagttattcttcaaaaattcagaaaaaacacctggaaaggctcaacttgtattaagaaagaccccttttaatcctactgagtggagagctttagatatgattaaagtacctactgaggattttatagaagaggatgtaggtaaaagtgatgtagagacatattctatatttacagcaacacctgcaggtatgttgaaagagcttaacggtgatgtattttctaaaccacaattccaccctgaattaactgatagatatggttatactaaatttgaagtagaaaatatttatcttagtacaaaatcaggttcagctactgaggattcagattcttcaggtgatgataatggcacagaacgaggaacttattctaaaattatgaaagatttaagtaactatggaagagataatatatctaaaggtatagataagtatacaagtaaattatcttcaaaatataaaaacttaaaaaaagcccaagctaaaaaaattatagagaagtttgttaaagaaggaaaagtaacagaaaaagaatatgaaaaaataacaggtaataaggtagatgatgaattaacatcagataacagaccgaagttgacaaaagataaattaaagagtatactaaaagagaagtttaaaacacaagatgattttaataattctaagaaaaagaaaaaagctaagacagatgcacttaaagaattgacaactaaatatcgttttggtaataaaacacatgctacaactttattagatgaatatattaaatataaaggagagccacctaacgatgaggcttttgataaatatcttaaagctattgaaggtgttagtaatgtagctacagacacaggttcagatgcaagtgatagccctttagttatgttttctagaatgctatttaattggtatcatggtaaccctaacttctatgcaggagatattattgttttaggagaccctaagtatgacctaggtaaaagattatttattgaagataagcaacgaggagacacttgggagttctatattgaatctgtagaacataaattcgattataaacaggggtattatacaactgtaggagtaactagaggtttaaaagacgctattctagaagatggtaaaggtagtccgcatagatttgcaggattatggaatcaatcatcagacttcatgggaggtcttatgggtgaagatacttctaaagaacttaaagaaaaaggtgtagcagagaaacaaagtagtggagataaagatggtggttctgatagtggtggagctcaagatggtggctctttagattcacttaaaaaatataacggcaaacttcctaagcatgacccaagttttgttcaacctggtaaccgacattataagtatcagtgtacatggtatgcttataatagaagaggtcaattaggcatacctgtgcctttatggggggacgccgccgactggataggtggtgctaaaggagcaggttatggtgtaggtagaacacctaaacaaggtgcttgtgttatatggcaaagaggagttcaaggaggtagcccacaatatggtcacgtagcgtttgtagagaaagtattagatggaggtaaaaaaatatttatctctgaacataactatgctacccctaatggatatggtactagaacgatagatatgagttcagccataggtaagaatgcacaattcatttacgataagaaataaaggaggatagtctatggcaacagataaagaagctaaagatgttattgataaatttatagacaatgtatttaattttgatgtacttacaaaagaaagaataaaagaaaaagatgaagaaattaaaaaaataactacagatgatatgtatgaaaaggttgtgtatatacgaccttatgttggagtaatacaaagccttaaccctcagcatgttcagtatgaatcattttctaataatggttatgatatagaggcagaattaagtttcaggaaagtaagttatttagttgataaagggtctatacctacagattctttatctactttaacagttcatttagtagaacgaaatcaagaactattaatagattactttgatgagatacaagatgtgttgtatggagaatatatggaagaagaatatgtatttgatgaagatgtaccattaagtacgatactagcattagacttaaatgataatcttaaatccttatcaaatataaagtatatgttcaaaggtgctcctaaagagaatccatttggaacagataaagatgtttatatagatacttataacttattatactggttatatttaggtgaagatgaagagttagcatatcctatgaatattaactacttctttacagagggaagattctttactatattcggtaaaggacataagtataaggtagatgttagtaaatttatagttggagatatattattctttggtagaagtgatactaatataggtatttatgtaggagatggggagtttatatctatgatgggtaaattccctaaagatgaaacacctataggaaaatataaacttgatgattactggaatgaatttaacggaagagttatgagattcgatgaagaggtgtatatttaatggtagtaagattccaatcttccatggggagaagtttaaaaagagtagattcggatgatttaaatgtaaaaggattagttttagctacagttagtaaaattaattataaatatcaatcagtagaagttaaagttaacaatttaactctaggaagccgtataggtgatgatggtagcttagctgtaccttatcctaaatctttcataggaagaacacctgaaggaagcgtattcggtacaaaacctcttattactgaaggttctgtagtattaatagggtttctaaatgatgatataaatagtcctattattttaagtgtttatggtgataatgaacaaaataaaatgattaataccaatcctctagatggaggtaagtttgatacagaaagtgtttataaatatagtagttcactatatgaaattttaccatctttaaattataaatatgatgatggagaaggaacaagtattaggacttataatggtaaatcatttttctctatgacatcaggtgaagaagagaaacctcaggcaacagatttttatactggaactgagtatcaagatttatttacttcttattatggtaataagacattaattgagcctagaatacaaaaggctcctaatatgttatttaaacatcaaggagttttttatgatgatggcacgccggataatcatataactactttatttatatctgaaagaggggatataagagcctcagttttaaatacagaaacacagaaaagaactacacaggaaatgtcaagtgatgggtcttatagagttatcaaacaagatgacgatttaatgttggatgaagctcaagtttggattgagtatggtattagtgaagataataaattttatattaaaaatgacaagcataaatttgaatttactgatgagggaatctatatagatgataaacctatgttagaaaacttagatgagagtatagcagaggctatgaagaatttgaatgaaatacaaaaagaactcgatgatataaactaccttctcaagggtgtaggtaaagacaatttagaagaattaatagagtctacaaaagagtctatagaagcttctaaaaaagcaacttcagatgtcaatagacttacaactcagatagcagaagtgagtggtagaactgaaggtattataacacagttccaaaaatttagagatgagacttttaaagatttttatgaagatgcttctactgttattaatgaagtaaatcagaatttccctactatgaaaacagatgttaagaccttaaagactaaagttgataacctagagaaaactgaaataccaaatattaaaactagattaacagaactagagaacaataataacaatgctgataaaataatctcagatagaggagaacatataggtgctatgatacagttagaggaaaatgtcacagtacctatgagaaaatatatgccaataccatggagcaaagttacttataataatgcagagttttgggattctaataatcctactcgattagtagtacctaaaggaataacaaaagtaagagttgcaggtaatgttttgtgggactctaacgccacaggacaacgtatgttgagaatattgaaaaatggtacttatagtataggattaccttatacaagagatgtagctatatctacagcacctcagaatggtactagtggagttattcctgttaaagaaggagattactttgagtttgaagctttccaagactcagaaggtgacagacaattcagagcagacccttatacatggtttagtattgaagctatagaattagaaactgaaactatggagaaagactttatgcttataggacatagaggagcaaccggatacacagatgagcacacgataaaaggatatcaaatggctttagataaaggtgcagattatatagaattggatttacaattaacaaaagataataagttattgtgtatgcatgattctactatagacagaacaacaacaggaacaggtaaggtaggagatatgaccttatcttatatacaaactaactttacatctctcaatggtgagccgataccatctcttgatgatgtactaaatcattttggaacaaaagttaaatattatatagaaactaaacgtccgtttgatgctaatatggatagagaattattaactcaattaaaagcaaaaggattaataggaataggttcagagagattccaagtaattattcaatcatttgctagagaatctttaattaatattcataatcaattctctaatatacctttagcttacctaacaagtacattttctgaaagtgaaatggatgattgtttaagttatggtttttatgctattgcgcctaaatatacaactataactaaagaattagtagatttagctcatagtaaagggcttaaagtccatgcatggacggtaaacacaaaagaagaaatgcaaagcttaatacaaatgggtgtagatggattctttacaaactacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtatagatttaaagttaaccctgagaactacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaaaatggaagagttacaaagtagagttagtgaatatgctatgcaaggtggcagtggtaatgtaagtggttcttacttacaattttttaactttacagatgatagttattataaagttcatttagctcctcaggggttaaagataactaggtctaaagatgaaccattactttttagatatgaaataacattagtagttattggttcattaacagaagcagatagaagtgctgtaacaacagaagagtttggtaacgttaaacctaatgcttctcaaagagtagatgagggtataaaagaattagataaaaatgctcgtaaaacgagagatagaaacaatcaagaaatatctagaagagaaaatacaatacctaaatctacaggagataatacgaacgagggtaatagacttaagcaaagcttccctagtagttctatatataatcctagacaatctactaacggattaaaaggtaatattgacaatatggcgctgataataggttacggtgatggaggtgtatctagctaatgaataattttataccacaacctcaaggtctacttagatttttaaataccctagatacagatttaacttcttctcatatgaatttactggatgaagaggtatcatttgtatctaaattttatacaccacagctacaattaagtgaattagcaaaaaaagtattgacaaatataaagacagatgatatacctgtattagaaagagaatttaatgataatacaattatccataaagctaacgatacattactaaaagtacaggctccaagaatgtatatgattctacagtcgattgtacttgaagcatatgctattgttaattgctttgtagaaaatccgagctctttaaaatacttaactgaagaagatgttagtataacacgggaaaatttaaattatgtagctgactacttaggtaactatgatgactataatagtgttgtcttagacttaagagatttagacttatgttttagtgctatagaattacaattacctctaatcaaaaaggaggctaacgtataatgagatttaagaagcacgtagttcaacatgaagaaacgatgcaagcaatagcacagagatactatggtgatgtgagttattggatagacctagtagagcataataatttaaagtacccctatttagtagaaactgatgaagaaaaaatgaaagaccctgaacgattggcttctacaggtgatacactgattatacctatagaatctgatttaacagatgtatcagcaaaagaaattaattctagagataaagatgtactagttgaattagctttaggaagagatttaaatattactgcagatgaaaagtattttaatgaacatggtactagtgataatatactagcattcagcacaaatggtaatggagatttagatactgtaaaaggcatagataatatgaaacagcaattacaggcacgtttattaactcctagaggttctttaatgctacatcctaattacggttcagatttgcataatttatttggtcttaatatacctgaacaagctacattaatagaaatggaagtattgagaacattaacatcagataatagagtaaaatctgctaatctaattgattggaaaattcaaggtaatgtttattcaggtcaattttcagtggaaataaaatctgttgaagaatcaataaattttgtcttaggacaagatgaggaaggaatttttgctttatttgaataggaaaggattaaattatgaaaactagaaaattaactaacatactatcaaaattaatagataagacaatggcaggtacaagcaagataacagactttactcctggttcagcttctcgttcattattagaagctgtatcattagagatagagcaattctatattctaacaaaagaaaatattgattggggtatacaagaaggtatcattgaagcttttgattttcaaaaaagacaatctaaaagagcttatggtgatgttactattcaattctaccaacccttagatatgagaatgtatatacccgcaggaacaacttttacttcaacacgacaagaataccctcagcaatttgaaacattagttgattattatgcagagcctgattctactgagattgttgttgaagtttattgtaaagaaacaggggttgcaggtaatgttcctgaaggaacaattaatactatagcatcaggttctagtttgattagaagtgttaataacgagtattcttttaatacaggaactaaagaagagagccaagaagactttaagcgcagattccactcttttgtagaatctagaggtagagcaactaataaatcagtaagatatggtgcactgcagatacctgatgtagaaggtgtttatgtttatgaagaaacaggacatattacagtatttgctcatgatagaaacggtaatttatcagataccttaaaagaagatataattgatgctttacaagactatagaccaagtggtataatgttagatgttacaggtgtagaaaaagaagaagttaatgtttctgctacagtaactatatctaataaatctagaattggtgatacattacaaaaacatatcgaaagtgttattagaagctatttaaataatttaaaaacttctgatgacctaataattacagaccttattcaagctataatgaatattgatgatgtattaatatatgatgtgtcatttgataacctagatgagaacattatagtaccgccacaaggaattattagagcaggagaaataaaagtagaactaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagtaagttacaatcttctctaaagacatctaccagtgaatatttagataagtttggggattggttcggagtttatcgtaagaccgatgagaaagatgatgtttatagagcaagaattataaaatatttactcttgaaaagaggaactaataatgctataatagatgctataaaagattatttaggtagagatgatattgatgtaagtgtatatgaaccttttacaaatattttctatactaacaaatcacatttaaatggtgaagaccacttaatgggatactattatagatttgctgttattaatgtctctataggtgattatttccctgtagagattatagatgtaattaatgaattcaaacctgcaggtgtaactctatatgtcacttatgatggggcttctactattagaggtggagcaattattaagtggttagatgggttacctaaaatagaaacataccaagagtttgatagatttacaggttatgatgatacattctatggtcatattaatatgaatcaaagtaaagatactgataacagttcatcagatatttttaaaacaaaccatagcttaattaatagtttagatgttttaacaggttcatctagtgtagggagacagtatattaactacggatatgtaacatcatatgtttataatccaggtatgacatcttctgtaaatcaaataagcgctagtacagaaggtagaggtcaagaagtacctactgactattatatgtatactagtactaagaataacaatacagtagaacttagtatgcaaactacttccggtgtgtcttatttatataataactttaattttagggactatatgagtaaatatagacctcaagtagatttacaatctgatgaggctagaagaattgtatctgattatataaaagaattaagtattgattactatcttagtgctgtgatacctcctgatgaaagtatagaaattaaactacaagtttatgatttttctattaatagatggcttacagtatcaattaataatttatctttctatgaaaaaaatatcgggagcaatataggatatataaaagattatctaaacagtgaattaaatatgtttactaggttagagataaatgcaggtaaaagagattcagtagatattaaagttaattacttagatttaatgttttattactatgaacgaggtatttatacaataaaaccgtataaagcattaatagaaaattatttagatatatctagagagacttatgtagaagcatttaaaatagcatcattatctaatggagatattataactaaaacaggttttcagcctatagggtatttaaaactagttggtaattatgaaaatacaatacctagcacaataaatatagtagctaaagatacagataataaccctatagaatctaatgaattagatgtatataatacagtagagaatagaaatttattacaatcttataaaggtgtaaatacgatagctagagaaataacttctacaaaagagtttactgtatcaggatgggctaaagagatatactcaactaattatctttctaaagtattaaaaccaggtaaagtgtatacgttatcttttgatatggaaataacaggtaatgacccaactcttaaatcttattctgataatcatggtatatatttatacagtaatactaagggaattgttgttaatggtgttaaatctatggaacgtactataggtaacaaagtatccgtaactcaaacttttacagcccctactattactgaccatagattactaatatatactggaagatatacatctgatggtaaagcatcaactcctccagtgttctttaatacagttaaaattacggaattaaaattgactgagggttcttctaagctagagtactcacctgctccggaagataaacctaacgtaatagaaaaaggaattaaatttaataatatcctaactaatatacagactttaagtattaattcggatactatcttaaaaaatgtaactttatattattcttactatggtgatagttgggtagaactaaagactctaggaaatattagtactggagaaacaacagaaaccaataacttaatagatttatatggattacagacagtagattattctaatataaatccaatgtctaaagtatcattacgttccatttggaatgttaagctaggtgaattgaacaatcaagaaggttctttatataatatgcctaatgattactttaatgctgtatggcaggatatagataaattatcagatattgagctaggttctatgagaatggttaaagacactgagggcggagtattcgatggagctacaggtgaaattattaaggctactctatttaatgtcggtgcttatactgatttagatatgttagcctatactttgactaattatactgaaccgttaacgttaggctctagtcgattaataattgagctaaaagaagaactactaacatcagaatcatttaatgtcgataatagaattaaagtaattgactcaatatatgaggagttaccaaatacaagcattattaaaaatggatttgttgaaagagaagttacaggttctaaatatttagattacggtttatatgagcctatagaagatggtactagatataaacttattgtcgaaggagaatttaaagataatatagaatttatatctttatacaattctaaccctaactttaatgaaacatttatatatccatcagagataattaatggagttgctgaaaaagaatttattgcaaaaccatctactgaagacaaaccaaggttaaatacagatgttagaatatatatacgaccttatgattcaactatctctaaagtaagaagagtagaattaaggaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatataaaaaagctactaaagttactttagttagaccttctaaatcacctgaagatgataataagaatttaatttcttatggtaataaatcgtgggtagaagtaacacctgaaaatgctaaagctgaaggagctaaatgggtttacttagaaagtagtattgttggtgacgaactacctcttggaacgtacagacaggtaggatttgttatggacttagtagcaaaaagtggtattagtaaatttaacttagtacctagtgaagtagaatcaactggaacattattattctttgataataaacaattccaaaatagaagtgagcagacaactgctaaagaaagatttattgtagaagtttaaaggaggatgattatttatggtattcacattagaggatttcgtgggagattggcgacagacggcaggttataacttagaccaggttttagagcaaggtggtgtatcttctttgtttcagaacttgggagtcagtgttacacctattcagcgtatagtcttgagtggtgagaacggattaaagattgatatccatgtcattattccttacgaaggattgtcaggagatcaaatgggacagatcgaaaagattttcaaggtagtgtacccagtcgatgaccaccacttcaaggtaatattgcactatggtacattggtaatcgacggagtaacacctaacatgatagactatttcggaagaccttacgagggtatcgcggtcttcgatggtaagaagattactgtcacgggaactttgtggaacggcaacaaaatcatagacgagagattaataaaccctgacggaagtttgttgtttcgagtgacaataaacggagtgactggttggagattgtgcgaacgtatattagcttaataaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggtgatgcaatattcaaagacggagataaacaatcagggcttggattcacattgtctgaagataatgtattgacagtaaatcctggttatgtatatatcaatggtaaaataagatattacgataatgacgattcagttaaaataactggcgtaggtaaagaaactattggtattaaattaacagaacgtattgttacacctgatgaagatgctagcctattagaccaaactagtggagtaccaagttacttctctaaaggtgcagatagattagaagaaaagatgtcattaacagttaatgacccgacatcagcaactatttatactttcatggatggggatttatatattcaatcaactaatgctgagatggataaaatcaacaaagtattagctgaacgtacttatgatgagtcaggttcatataaagtaaatggttttgaactattttcagaaggtaatgctgaagatgatgaccacgtttctgtagttgtagatgcaggtaaagcctatgtaaaaggttttaaagtagacaaacccgtatcaacaagaattagtgtacctaaatcttatgacttaggaacagcagaaaatgaaagtactatctttaataagtctaataactctattagtttagctaatagccctgtaaaagaaattagacgtgttacaggtcaagtacttattgaaaaagaacgagttacaagaggagctcaaggtgatggtcaagattttctttcaaataatacagcatttgaaattgtaaaagtttggactgaaacaagccctggagttactacaaaagagtataaacaaggagaagacttcagattaacagatggtcaaacaattgattggtcacctcaaggtcaagaaccttcaggaggtacttcatactacgtttcttataaatataacaaacgtatggaagccggtaaggattatgaagtaacaactcaaggtgaagggttaagtaagaaatggtacattaactttacaccttcaaatggtgctaaacctattgaccaaacagtagtattagtagactatacttactacttggctcgtaaagattcagtgtttattaataagtatggtgatattgcaatattacctggtgaacctaatattatgagattagttacaccaccattaaacacagaccctgagaatttacaattaggtacagttacagtattacctgattcagatgaagccgtatgtatttcatttgcaatcactagattgtctatggaagacttacagaaagttaaaacaagagtagataacttagagtataaccaagcagtaaatgctctagatgatggtgctatggaaggacagaaccctctaacattacgttcagtattcagtgaaggtttcattagtcttgacaaagcagacattacacatcctgacttcggaattgtatttagttttgaagatgcagaagctactctagcttatacagaagcagttaaccaacctaagattattccaggagatacaacagctcatatttggggtagattaatttcagcaccatttactgaggaacgtacaatctaccaaggtcaagcatcagaaacattaaatgttaacccttataatattcctaacaaacaaggtgtgttaaaattaacacctagtgaggataactggattgatactgaaaatgttacaatcactgaacaaaaaactaaaaagtaactatgaaacgattttggagacataatgaaagttactatggtgagactgagcattacttgtattctaacttacagttagatgcaggacaaaagtggaaaggtgaaacttacgcttatgatagagagcatggtcgtaccggtactttattggaatcaggaggacaacgtactctagaagaaatgattgaattcattagaatcagagatgtatccttcgaagttaaaggactaaaccctaatgataataatttatatttattatttgatggagtaagatgtgctataacacctgcaactggctatagaaaaggctctgaagatggtacgataatgacagatgctaaaggaacagctaaaggtaagtttactattcctgcaggtattcgttgtggtaaccgagaagttacacttaagaatgctaactctacaagtgctacaacttacacagcccaaggacgtaaaaaaacctctcaagatattattatcagaactcgtgtaacagtaaacttagtagacccgttagcacaatcattccaatatgatgagaatagaactatatcatcattaggattatactttgcttctaaaggtgataaacaatctaatgttgttatccaaattagaggtatgggtgaccaaggttatcctaataaaacaatctatgcagaaacagttatgaatgctgatgatattaaagtatctaataatgctagtgctgaaactagagtatactttgatgaccctatgatggctgaaggcggtaaggagtacgctattgttattattactgagaacagtgattatacaatgtgggtaggtactagaactaagcctaaaattgataaacctaatgaggttatttcaggtaatccatacctacaaggtgtattattcagttcatcaaacgcatcaacatggactcctcaccaaaactctgaccttaaatttggtatttatacttctaaatttaatgagacagcaacgattgaattcgaaccaattaaagatgtatcagcggatagaatagttcttatgtctacgtacttaactcctgagagaacaggatgtacgtgggaaatgaaattaattctagatgatatggcatcttctacaacattcgaccaattgaaatgggagcctatcggtaactatcaagacttagatgttttaggtctagcaagacaagttaagttaagagcaactttcgaatctaatagatatatctcaccattaatgagctctagtgatttaacattcactacattcttaacagagttaacaggttcatatgttggtagagctattgatatgacagaggctccttacaatacagtaagatttagttatgaagctttcttacctaaaggtactaaagttgttcctaagtattctgcggatgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaaattatttatacctacagttgaggaaaaatcaattaaggaattagaaaaaacatacaaagaaaaaattgatgaagctactaagttaatcaatgaattaaagaaagagagaggagaaaaatagatggcatttaactacacgcctcttactgaaacacagaagttaaaagatatgtatcctaaagttaatgatataggtaactttttaaaaacagaagttaaccttagtgatgtaaaacagatatcacaacccgactttaataatattttagcatctatacctgatagtggtaactattatgtaactaattcaaaaggtgctcctagtggagaagctacagcaggatttgtaagattggataaaagaaatgtaaattattataaaatttactattcaccatatagcagtaacaaaatgtatatcaagacttatgctaatggtactgtatatgattggattagttttaaattagatgaaggtagcttatacaatgaaggtaatactttgaatgtaaaggaacttactgaatccacaactcaatatgcaacactagttaatcctccaaaagagaacttaaatacaggttgggttaattacaaagaaagtaaaaatggtgtttcttctttagtagaatttaacccggttaactccacttcaacttttaagatgataagaaagttaccagtacaagaacaaaagcctaacttattgaaagatagtttatttgtttatcctgaaactagctattctaatattaaaacagataactgggatacgcctccattttggggatattcttctaatagtggtcgttcaggagttagatttagaggagagaatacagtacagatagatgatgggtctgatacgtacccttcagtagtttctaataggtttaaaatgggtaaagaactttctgtaggtgatactgtaacggtatcagtatatgctaaaattaatgaccctgctttacttaaagataacttagtttactttgaattagcaggatacgatactgtagatgatactagtaaaaatccttatacaggaggacgtagagaaataacagcaagtgagataacaactgagtggaaaaaatactctttcacattcactatacctgaaaatacaatcggagcatcaggcgttaaagttaattacgtatctttactactaagaatgaattgttcatctagtaaaggtaatggtgctgtagtatactatgccttacctaaattagaaaaatcatctaaagttacaccatttattacacatgaaaatgatgttcgtaaatatgatgagatttggtctaattggcaagaatttattagtaaagatgaattaaaaggtcactcccctgtagatattgaatataatgattattttaaatatcagtggtggaaatctgaagttaatgaaaagagtttaaaagatttagctatgacagtacctcaaggatatcatacattttattgtcaaggctctattgccgggacgcctaagggacgttctattagaggaaccattcaggtagattatgacaaaggtgacccatatagagctaataagtttgttaaattattgtttactgacacagagggtattccttacacattatattatggtggttataaccagggttggaaacccttaaagcaatcagaaacttctactttactatggaaaggtagtttagattttgggtctacggaagctgttaacttaaatgactcattagataattacgatttaattgaggtaacttattggactcgttcagcaggacatttttctacaaaaagattagatataaaaaatacatcaaatttactgtatattagagattttaatatttcaaatgatagtacaggttctagtgtagacttttttgaagggtattgcacttttcctactagaacatcagtacaacctggtatggtaaaatctatatctttagacgggtctacaaatacaacaaaagtagcatcatggaatgaaaaggaacgtataaaggtatacaatattatgggaattaatagaggataaagaaaggtggaataaaaaaactatggctgttaaatatgatataggtaataatgagatagtattacatttaagagaaggtaaatatataacagggtttacaacagtaggagggtatgataaggagttaggacaagtaaaagttaatagagaaatcttacctgcttacttctttgataattttgcctatgaaagatatttgtattatagtaaacctgaagaggttatagaaaataaaaactatgtaccaccacaaatcaatgatgatgatgaggaatcccaacaaattactgtacctaaagaacaatatgatagtttaaaagaagaactagagcttatgagaaaacaacaagaagctatgatggaaatgcttcaaaagctcttaggtcaaaaggggtaattataaatggcattaaattttactacaataacggaaaacaatgttattagagacctgactactcaggtcaataacattggagaagaattaacaaaagaaagaaatatatttgacattaccgatgatttagtttataattttaataaatcacagaaaattaaactaactgatgataaaggattaactaaatcttatggaaacataacagcccttagagatataaaagaacctggttattactatataggtgctagaacattagcaacattattagatagacctgatatggaatctcttgatgttgttttacatgtagtacctcttgatacttctagtaaggtagttcaacatttatatacactatctactaacaataaccaaattaaaatgttatatagatttgtctcaggaaactctagttcagaatggcaatttattcaaggattacctagtaataaaaatgctgttatatcaggaactaatattttagatatagcttcaccaggtgtttactttgttatgggaatgacaggaggaatgcctagtggagtaagctccggatttttagacttaagtgtagatgctaatgataatagattagctagactaactgatgctgaaaccggtaaagaatatactagcattaagaaacctacaggaacatacacagcctggaaaaaagaatttgagccaaaagatatggagaaatatctactaagtagtattagagacgatggtagtgcatcattcccactcctagtttatactagtgatagtaaaacatttcaacaagctattatagaccatatagatagaacaggtcaaacaacctttactttctatgttcaaggcggtgtatccggttcccctatgtcgaatagttgtcgagggttattcatgtcagacacacctaatacttctagtttacatggtgtttacaatgctataggtacagatggtagaaatgtaacaggttcagtggtaggtagtaattggacttcaccaaaaacatccccttctcataaagaattatggacaggagcacaatcattcttatctacaggaactactaagaatttatcagatgatattagtaactactcttatgtagaagtttatactacacataagacaacagagaagactaaaggtaatgacaatacaggaactatatgtcataagttttatttagatggtagtggaacttacgtttgttcaggtacatttgtttccggggatagaaccgatacaaaaccccctatcacggagttttatagagtaggtgtatcttttaaaggttctacatggactcttgtagatagtgcagtacaaaatagtaaaactcaatacgttacaagaattataggtattaatatgccatagactaggagaaatttcctagtctttttttttcttgacttgaaaaggattctgtggtatactataactcgtgtaaggatataaggagattaaaatgagattaagaattaagaacttatatacctatgtagaatttgaggaggatgataaatacttaaaagatatatttttaaagagagtccatacgactataggagcaagacaagaaggatttcagtacagccctgcgtacaaaagaggtagttgggatggttatgtagatttttatgtttatgaggaagataaattccccactggacttttatttaaaattgagttattattaggtgagctacaatcaaggtataatttccagtttgaaacaattgatgagcgtgatgaaagtttcttatctgaagaagatattgatgatgagataacattgcttgataataatgtcggtcaaattaccttaagagattaccaatatgaagcagtgtacaatagcttaacattttacaatggtattgctcacttagctactaatggtggtaaaactgaggttgctagtggtattatagaccaattattacctcaattagaaaaaggtgagagagtagcattcttcacaggctctacggagatattccatcagtctgcagataggctccaagagcgtttaaatattcctattggtaaagtaggtgcaggtaagtttgatgttaagcaggttacagttgtaatgatacctactttaaatgcaaaccttaaagacccaacacaaggggtaaaggttacgcctaaacaaaatattagtaaaaagattgctcaagagatattacctaaatttgaaggtggaacaaatcaaaagaaattactaaaagtattacttgataacacaacacctaaaacaaaagtagaacaaaatgtattaagtgccttagagataatttaccaaaatagtaagacagatgcagaagttttattaaacttaagaaatcataatgcacattttcaaaaaattgttagagaaaagaacgaaaagaaatatgataaatatcaagatatgagagattttttagactcagttacagttatgatagttgatgaggcacaccattctaaatctgattcttggtacaataatttaatgacatgtgaaaaagctttatatcgaattgcattaacagggtctatagataaaaaagatgaattactttggatgagattgcaggcgctattcggtaatgttattgcacgaactactaataagtttttaattgatgaaggtcattctgctagaccaacaataaatattatacctgtagctaatcctaatgacatagatagaattgatgattatagggaagcttacgataaaggtataacaaataatgattttaggaataaacttattgcaaaactaacagaaaagtggtataatcaagataaaggtacattgattattgtaaacttcattgaacatggagacacaatatcagaaatgttaaatgatttagatgtagagcattacttcttacatggagaaatagactctgaaactaggagagaaaaattaaacgatatgagaagtggtaagcttaaagtaatgatagctacatcacttattgatgagggtgtagatatatcaggtattaatgcactaatattaggtgcaggaggtaagtcattaagacaaacattgcaacgtattggtcgtgctttacgtaagaaaaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaaaaacacaaagaaagctataccaatatctagaggaaaatgctacagaaaataaatttcatatttctactaagaaagagctagcagattctctaggtgtttccatctctgctttatccaataaccttaaaaagttagaagaagaaaataaagtcgttactgtttctaaaagaggaaaaaacggcggggtaataataactttagttagagagtatgacacagaagaattgaaagaattcaataattctacagataatattattacttccgatttacagtatgctaaggcattaagagaaaagcacttcccttcttatagatatgagagaaaagaacaacgtagacgtactaagatagaaatggcacaatacaatgccattaaggatgagaagagaagaattatagcagatatgaatttctattcagaaggtcttccttatccttctaaagatatttttaatatgtcctatgacccggaagggttttataaagcgtacatcttatgtaagttatacgaccaatatgctatttctcatatggatgctaaacatacaagtcatcttaaagcaatgagtaaggcaacaactaaagatgaatacgactaccatcaacatatgtctgaatactatagaaataaaatgattcaaaatttacctagaaatagcgttagtgataatttctttggtagtaaaatgtttaatactttttataatttttatttaaaaataaaagataaaaatattaatgtatttaagtatatgcaaaatgtatttaaaaatgtaacattttattacgagaacggtatgcaacctaatccaataccttctcctaacttctttagctcagataagtattttaaaaactataataattatattaaaggaataaaaaaaggtgttaacagtactaatagacacctaggtgatacagacagcatcattaattcatcagactatgtgaaaaaccctgctgtattacatctacaccaactatatactacaggattaaattctactttacatgatattgatactatgtttgaacaagccttagaccttgaaaatgcctcctatggattatttggagatatgaaacatattattttactacagtataattctatgattgaagaagaaattaagaatttacctagagaagaaaaggatattattaataaatatgtaaaacaatgcataattaatgattattcaccaacaagtatttcaccttctgcaaggttatcaatgtttactatgcagaaagagcatatagtttacaataagcagttaaataaaggaatcaagagagaggatttattaccattaagtctaggaggtatagtgaataaagatttattgagtggtatggatatacaaaacttagaacagaatggtaatgaatacctatatatgagacaacatacttcaacttattatatattaagaatgtttggtgactatttagggtatgaggtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtattagataacttacctaagaatctattttcagcagagtctgaggacatgggttacttatttacagctataaagagaacagcacatatttccgataagatgtcaaatgaagcattagcaattaaagtagaacagcttatgggtaataataaggaagatgaagagaaagtaaccaagacattaacttacttagaagatttatataaagtagacgttaatgaaaaagatgaatctgttaattatgaaatagagaagtatattaaaacagaaatgtcaaaagaagttttagttaaatttattgcagaaaataaacaagaagactctgataatctacatgaacttgtagacaaactaaagcaaatagaagtaagtgacatctcaggaggtaatggggagtttattgacttcttcgaagatacagaaaagaaacaagaactattgagtaatttagctacaaataaattctctactggatttacttctattgacaaccatattgaaggtggtatagcaagaggagaggttggattaatcatagctcctaccggtagaggtaaatcattaatggcttcaaacttagctaagaattatgttaaaagtggattaagtgttttatatattgccttagaggaaaaaatggatagaatggttttgcgtgctgagcaacaaatggcaggagcagaaaagagtcaaattgtaaatcaggatatgtctttaaataataaagtttatgatgcaatacaaaatcattatcagaagaatagaaagttattaggtgacttttatatttctaaacatatgccaggtgaagttacaccaaaccaattagaacaaattattgtcaatacaacaattaagaaggataaaaatattgatgttgttattattgactatcctcacttaatgagaaatccttatgctaaatatcattcagaatcagatgcaggagggaaattgtttgaagatattcgtagattatcacagcaatatggatttgtttgttggacgttagctcaaactaaccgtggtgcttatggttcagatgttattacaagtgagcatgtagaaggttctcgtaagattgtcaatgctgttgaggtgtctttagcagtaaaccaaaaagatgaagaattcaagagcggtttcttaagattgtatttagataaaattcgtaatagctctaacacaggagaacgatttgttaatcttaaagtagaaccaactaagatgattgtaagagatgaaacacctgaagaaaaacaagagcatatacaattgctatcagataatggaaaagaagacacaagtaaatttcaaaataaagataataaaatagaagctataaataacacattcggaggattaccgggagtttaattttttaaaatatacaacttgacattttatatgttaggtggtataattattttataaagaataaaggagagattaataatgaaatttgtattctttacagatagccactttcacttatttactaactatgctaaacctgatgagcagtatgtgaatgatagatttagagaacagatacaagctttacagaaaatgtttgatattgcaagagaagaggatgcaacagttatatttggtggggatttattccacaaacgtaacgcagtagatactagagtatataataaggtatttgaaacattccaacttaatagagatatagaagtactaatgttaagaggtaatcatgattcagttacaaatagtttatatacagattctagtatagaacctttcggttacttacctaatgtagaggtttgtaaaaaccttgatactttagggtttttaggagaagaacaggatattaatattgttatggctccttatggagacgagactgaagaaattaaagagtttattaaaaataaatatgtagaagatagagtaaatatcttagtaggtcatttaggtgtagaaggctctttgactggaaaagggtctcatagattagaaggggcatttggataccaggatttattacctgataaatatgatttcattttactaggtcattatcaccgtagacaatatttccaaaatccgaatcatttttatggtggttcattaatgcaacaatcattttctgatgagcaagaagctaatggtgttcatttaatagatacagaaaaaatgactacagaattcatcccaatccatacacgtagatttattactattcaaggagaagatattcctgagaactttgaacagctaatcgaggaagataattttattagggttatcggtacagcaaatcatgctaaggttttagaaatggatgacagtatgaaagataagaatgttgaagttcaaattaaaaaagagtatactgtagagaaacgtattgatagtgatgtgtctgatgaccctttaacaattgctagtacctatgctaaacaatactcacctgaatcagaacaagaaatacttgagtgtttgaaggaggttttataatgaaaaaatatagagaatatctaaataagacagatgcagaaaatttagcagaggattgggagaaagtaaccgaagatttatggaaagtgtttaaagatatgaaacctaaaattaatacattagatatcagtaatgtagtaagtaaagacttagataaaagtaaacctattttacaattccaagattcagatggagtaatagagaatatttgtaatgttgaaggtttagaagatggtctaagtaaaatgaaaaagatttttgatgatagtaattttgaaaagcattattacaatagagtagtagaccatgatgagtattactggattgattatggctctcatcattgtttctttagagttacgaaaggggataagtaatggttgtatttaaacaagtagaagttaataattttttagcaattaaagaagctacgctagagttagacaatagaggattaattctaattgaaggtgagaataaatctaatgagtcatttcattcaaacggctcaggaaaatcaactttaatatctgccattacttacgctttatatggtaaaactgaaaaaggactaaaagcagatgatgtagtaaataatattgagaagaaaaatacatctgttaaacttaagtttgatattggggaagatagttatttaattgaacgttatcgtaaagataaagagaataagaataaagtaaaattattcgttaatgaaaaagagattacaggttcaacaaatgacgttaccgataaacaaatacaagatttatttggtattgagtttaatacttacgttaatgccatcatgtatggtcaaggagatatccctatgttctctcaagcaacagataaaggtaagaaagaaattcttgaatctattactaagacagacgtatataaacaagcacaagatgtagcaaaagagaaagttaaagaagtggaagaacaacaaaataacataagacaggaaatctataaactaggttatcagttatcgacaaaagatgagtactttcaaagagaaatagagcagtacaatcaatataaagaacaattggttcagatagaaaacagtaataaggaaaaagatagattaagagaacaagaggagaagcaaatagaagctcaaatagagcaactagcttcacagataccaacaatacctgaagatgaatttaagcactcagaggagtataataaagcctctcaaagcctagatttactttctaataaattaacggagttaaatcaagtttactcagagtataataccaaagaacaagtactaaaatctgaaatagctacattaagcaatagtctaaatcagttagatacaaatgaccattgtcctgtttgtggctcccctatagataattctcataaattaaaagaacaggaaaatatcaataatcagattgagaataagaaacaagagattactagtgtattagaaatgaaagatacgtataaagaagctattgataaagtaaaagataaatcacaagaaattaaagataaaatgtcacaggaagaccaacaagaacgagagcacaataataagattaacagcataattcaagaggcttctaggattaaatcagacattagttcattagagaataataaaacgtatttaaaagttaaatatcaacatcaatctgttcaaggattagagagagaagaaccaagtaaagaaaaacatgaggaagataagaaagaattacaagaatctattgacaaacatgaagagaatatagtacaattagaaactaagaaaggtaaatatcagcaagctgtagatgcttttagtaataaaggtatacgttcagtagtgttagactttattacaccattcttaaatgaaaaagcaaatgagtaccttcaaactttatcaggttcagatattgaaatagagttccaaactcaagtgaagaatgctaaaggagaactaaaagataagtttgatgttattgttaagaatagcaagggcggaggttcgtacaaatccaattcagcaggagaacaaaaacgtattgatttagcaattagttttgcaattcaggatttaattatgagtaaagatgagatatctacgaatattgcactttacgatgagtgttttgatggattagatactatcggttgtgaaaacgtgattaaattattaaaagatagacttaatacagtaggaacaatatttgtaattactcataataccgagcttaaaccactgtttgaacaaacaattaaaatcgtaaaagaaaatggagtatcaaaactggaggaaaaataatgaaattaaagattttagataaagataatgcaacacttaatgtgtttcatcgtaataaggagcacaaaacaatagataatgtaccaactgctaacttagttgattggtaccctctaagtaatgcttatgagtacaagttaagtagaaacggggaatacttagaattaaaaagattacgttctactttaccttcatcttatggtttagatgataataaccaagatattattagagataataaccatagatgtaaaataggttattggtacaaccctgcagtacgcaaagataatttaaagattatagagaaagctaaacaatatggattacctattataacagaagaatatgatgctaatactgtagagcaaggatttagagatattggagttatattccaaagtcttaaaactattgttgttactagatacctagaaggtaaaacagaagaagaattaagaatatttaacatgaaatcagaagagtcacaactgaatgaagcacttaaagagagtgatttttctgtagatttaacttatagtgacttaggacaaatttataatatgttgttattaatgaaaaaaattagtaaatagtaaggaaggatattatgaggtttgaagactttttaacccaagaattaggagaaccaaaagaaaatactataggtgagctaagatactgttgtccgttttgtggagaaaaaagttataagttctatgttaagcaagccctagactctagtaatggtcagtatcattgtaaaaaatgtgatgaatcaggtaaccctattacatttatgaagacttattataacattacaggtaaacaagcttttgatttattagagtctaagaatatagatatagagagagcccctttacttacgaccaataataaggatttgacagaatcagagaaacttatattaatgcttagaggtgtgcaccaagataaaggaaatactagtattaaacctcctagattacctgaagggtataaattattaaaagataacttaaataataaagagattataccctttttaaaatacttaaaaggtagaggtataactttagaacaaatcattaataacaatataggttatgttattaatgggagcttttataaagttgacggggaatccaaagtatcattaaggaatagtattatattttttacttatgataatgatggaaactaccagtactggaatacaagaagtatagagaagaacccttatattaaatctattaatgctcctgctaaacaagatgaagtagggagaaaagatgtcatatttaatttgaatatagcaagaaagaaaaagttcttagttataactgagggtgtatttgatgctttaaccttccatgagtatggagtagcaacattaggtaaacaagtaaccgagaatcaaataaaaaaaataattgattatgttagtatagatacatcaatatatattatgttagacactgatgcactagataataatatagacttagcttataagttaaaaacacattttaataaagtttactttgtacctcatggtgatgaagatgcaaatgatatggggacaaggaaagcctttgagttattaaaacagaaccgggtgttagtaacacctgaaagtatacagagttacaaaatacaacaaaaacttaaactttaggcttgaccttagagaagttttatgttatactagtaattaagtaattaataaaggagaaaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgagcagatgacagacttagaatataataatgagttaaacttaaatattttaattgacgctttatataaagcagagcttattaatgaagatgtattagactacattcaagaatcaattgataaatcacaagaagaacctaaaaatgaagaagaaaaaggagaacaagaataatggaaaaaaatattagcacacacacaaaaggtattagtcaagcagacatggagaaatggattgaagctgyagtacaaggaactgttgatggtaaacaagttgatgagaaaacagctaaacaattakatagaattggttcacgtagtgtttctttagaagaagcaactcgtattgctaaagttcttaatgctgtaacagctcaagaggttacaggagactttaatgatgcatttaatgcaattgacttaatgatgattatcatggaagatgagttaggagtaactcaagaaaaagtagggaaagctaaagataaactaaatgaaaaacgagaagcttacctaaaagagaaacaagaagaattacgtcaaaaacaacaagaagaggcacagaaaaaaactgaatctgacagcaatgaaaaagtaattcagttgaagaaaaatgacgaacagtaagaaaaaaggggatacattcgaacgtaaaatagctaaagaattaacttcttggtggggataccaattcaataggtctcctcaatcaggtggtgcttcatggggtaaagataataatgctgtcggagatatagtagtacctcaggaagctaattttcctttagtagtagaatgtaaacatagagaagaatggactatagataatgttcttctaaacaacagagagccacatacatggtgggagcaagtcattaatgatagtagcaaggtgaataagacaccttgcttaatatttactagaaatagagctcagagttatgttgctttaccttatgatgaaaaagtatatgaagatttaagaaataatgaataccctgtcatgagaacagattttattattgataatattagaaaagataaatttttttatgatgtccttataactaccatgaatgggttgacctcatttacaccttcttatattatatcttgctacgacaaaaaagatataaaaccatacaagaaggtcgagtctaatttatctgaggtaagtaagcatgaagatgaattgattaatgaccttcttagtgatatataaggaaggtaagataagtatgacaagtaaagaaagaccattaatcgtatatttttcaggtacaggacaaacagaaagattagtaaacaaaattaatattaataattcatttgaaacatttagggttaagagtggaaaagaaaaagtaaataaaccttttatactaataacacctacttataagaaaggtgcaatacctaaacaaatagaaagattcctagaaattaatgggagccctaaagaagttattggtacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagacaatacaagaaagtttaatagtgaagtagaaagaattagagtattgacaaaagaaggaacatatgataaaatatttgacaasgttcctgacactattattgatgaaatgactaagttagcttacagttttaattttaaattccctagtttcatggcagggcaaaagttttatgaatcttacgcatcaaaacagtatgatgaaaacaaaaaacctatttttgttgaagactatgaacaacataatgttcgagtagctttatatttatttcaaaatgactatgtaaaggctagagaattactagtacaacttatggagcaaacattccaaccatctacacctacgtataacaactcaggacaagctaatagaggtgaactaagctcatgttatctatttgtagtagatgattcaattgagtctttaaactttgttgaagatagtgtagctaatgctagttctaatggtggtggagttgcaattgatttaactagaattagacctaaaggagctccagtacgtaatagacctaattcaagtaaaggtgttattgcttttgctaaagctattgaacataaagttagtatttatgaccagggtggtgtaagacagggtagtggtgctgtttacctaaatatattccacaatgatatcttggatttattaagctctaagaaaatcaatgccagtgagtctgttagactagataaattatctattggtgttacaatccctaacaaatttatggagttagttaaagaaggtaaacctttctatacttttgatacttacgacattaataaartgtacggtaagtatttagatgagctaaacattgatgaatggtatgataagttactarataatgatagtatcggtaaagtaaaacatgatgctagagaagttatgacagayattgctaaaacacaattagaatcaggctacccttatgtattctatattgataatgctaatgataatcacccattgaaaaacctaggtaaagttaaaatgagtaacttatgtacagaaatttcacaattacaagaggtatcagaaatttatccgtattcttacagtaatcagaatgttattaatagagatgttgtttgcacattaggttctcttaacttggttaatgtagttgaaaaaggtttattgaatgaatctgtagatattggtacaagagcattaacaaaagttactgatattatggatttaccttacttacctagtgttcaaaaagcaaatgatgatattagagctatcggtttaggttcaatgaatttacatggacttttagctaagaatatgattagttatggttctagagaagcattagacctagtaaacagtttatatagtgctattaacttccaatctattaagacatctatgttaatggctaaagaaacaggaaaaccatttaaaggctttgagaagtccgattacgctacaggtgaatactttgtaagatacattagagaatccaatcaacctaagacagataaagctaagaaagtcttagataaggtttatattccaacacaagatgattgggatgaattagctaaagcagtgaaagtacatggtttgtataatggttaccgaaaagcagaagcacctactcaatctatatcttatgtacagaatgctacaagttctattatgccagtacctagtgctatagagaatagacaatatggagatatggagacatattacccaatgccttacctaagtcctataactcagttcttctacgaaggagaaacagcttataagattgacaataaacgtattattaatacaagcgcagttgttcagaaacatacagaccaagcagtgtctacaatactttatgtagagtcagaaatacctactaataaactagtatcattatactattatgcttgggaacaaggattaaaatcattatactatacacgttcacgtaaactttctgttattgaatgtgaaacatgttcggtttagaaaggaaatagatatggatattacacaaaaagtaaaacaacataataaaaatgctgtattaaaagcaacaaactggaatattgaagatgacgggatgtctgatatttattgggagcaaggaatctcccaattttggactcctgaagagtttgatgtatcaagagatttaagttcttggaatagtttaactgaaagtgaaaagaacacttataagaaagtccttgcagggctcacagggctcgatacaaagcaaggaggagaaggtatgaacttagtatcctaccacgaaccaagacctaaataccaagctgtatttgcgtttatgggtggtatggaagagatacatgctaaatcgtatagtcatatctttacaacattactaagtaataaagaaacaagttatttattagatacttgggtagaagaaaacgactttttaaaagtaaaagctcagtttatcggatattactacgaccaactattaaaacctaatcctactatatttgatagatacatggctaaagtagctagtgcctttttagaaagtgcattattctactcaggattttattatcctttacttcttgcaggaagaggtcagatgacacaatcaggagctattatttataaaattactcaagatgaagcttaccatggttcggcagtaggattaacagctcaatatgattataatcttctaacagaagaagagaaaaaacaagcagataaagaaacttatgaattattagatattctttacactaatgaagtagcgtatacacatagtctatatgacccactagaattaagtgaagacgtaattaactatgttcagtataattttaatagagctcttcaaaaccttggaagagaggactattttaatcctgaaccttataaccctattgtagaaaatcaaactaatgtagacagattacgaaatgttgatttctttagtggtaaagcagactatgaaaaatctacaaatatcaaagatattaaagatgaagatttctcattcttagatagtaaagaatacagtactgccaaggaattcctataaaaaggagaaaagatattatggatagaaaagaagcaatggatttactaagtaaagcagaaatattatttaaaaaacatgatgagttttcatgtgtaagtgatatcaatgaccctatgaagttattcagtaactctaaagatgctaaagctgatgatacgtctaaktcttttcagctagagtttatgcatgatatgaccatgtatactttatcttatggctcaggacagctaaaacttattgatttagcagaaggttatgaagcacaaaaagctacartagttaactcatttcccgaaattattaaaacattagaaaaggatgattcagaagatggaaaaaatgaatagtttagtagatttaaatacagcaattagacaaaagaaagatgttattgtcatgattacacaagataattgtggtaagtgtgagattttaaaaagtgtaatccctatgtttcaagagtcaggtgacattaaaaaacctatcttaacattaaatctagatgctgaagatgtagatagagaaaaagctgttaagttattcgatatcatgagtacaccagtattaattgggtataaagatggtcagttagttaaaaagtatgaagaccaagttacacctatgcaattacaagaattagagtcactttaatttggaatttcctactatctgtgctatactataatagtacaaggtagtaggattttttaatggaaggaagatgacatatcgcaaagaataaaacattaacgatatataatagtgatagatattttaatatacacacaaaagataaagataaaattaatgaggctattaaagtaacacacggtaatgaagaagaaattgaaaagaatatggatgaattaatatctaagtctagaagatatatcatgagggatgaaaagcattacatgctatttaatgagaagtacaataatgataggcttatagaaaaagtatgtaaacacggtggtaaagttacatactatactgattcagtattaccttactatgttttaaaagacttatctagtcaccctgactcagaagttgtttatcgtatgcgcaacggttttactgcaaaagaagtagataatatagctttatcattcatgggtacaaaagttattattgatatttctgtagtatttccttatgtaaacccttatgatattattagaagtttacatgatattaaaacaaatgtagatgaagttcatttatcatttccacgaatattaggggtagatgaaaaacaagaaaagttttatttctttgatggtgaagcttatgatttaaaacccgaatataaagtcgattttgcagataaaattagagtatctttatcagtatggaaaatgtatatctatatcttaacaagtagtcgtgattttgaggatgtagacaatgtaattacgaaattaaaacaacaacgaaagattaagatataaggtgattatatgagtacagcaaatagaagagatatagcaagaaagatatcagagaatacaggttactatatccaagatgtagaggaaatactaagtgcagagacagatgctatttctgacttgctagaagaagggtatactaaagtaaagaatcataaatttatgcaaatagaagttattgaaagaaaaggtaaaaaagcgtgggatggtctgaataaagaatacttccatttacctaatagaaaagctataaaattcaaaccactaaaagaactagaagaggttattgatagacttaatgaagaagagaaataattctcttctttttttattgacaaggtttaaaatatatggtatagtattattaagttaaaaaaggagaggaattaaatgaaagtattaatcttatttgaccacattagagaagagcatttttctgtaagtaaagatgggagtgtgaaatctaatgtactaaatacacctaacggaaaaacacttaagaaattacttgagaagtgttctaacttaaagagagataaaacaaacagagattatgatattgattttctctacaatgcagtacctacacctattagaaatgactacggtaaaatcattaaataccaagatgttaaacaagcagaagtaaagccatactatgagagaatgaataatattattattgataattcttatgatatggtaattcctgtaggtaaactaggtgttaaatacctattaaatgttacagctattggtaaagtaagaggtgtaccaagtaaagtaactattgaaaatggaacatcttctcatgatgtgtgggtattacctacttatagcattgaatatactaatgtaaataaaaatagtgaacgtcatgtagtatcagatttacaaacagttggtaagtttgtagagcaaggagaagaggcatttaaacctaaggaagtatcttacgagttggtagataacattgaaagagtaagagaaatattcaataaggaagtaaagaatgataattatgatggggtagatattaccgcatgggacttagagactaactcattaaaacctgataaagaaggaagtaaacctttagtactatctctatcatggagaaatggtcaaggtgtaactatacccttatacaaatcagactttaactgggaaaacggtcaagatgatattgatgaagtcttagaattgcttaagaattggttagctagtaaagaagatattaaagtagcacataacggtaaatgatttgctgttgtaaaatccctctcatatcgggcatagctttaagtagctgataagagaacctaagtcctgtaataaggatagtggtaatcccgagcttacattattggtgacaatagatggggtgtagagactgagccgaggttttgtagaccaaggtgagacatagtgtatcgacttaatagaggtggtacagtgaaaaaagattatatgacatcagttaaaaataacaaaaaagtatgtagaagatgcaacgaagaattagatttatctaactttaaaacatataagaagaatgataaaacttattatcaaagtatgtgtataccttgtcggaaggaatataataagttagataaaactaaaaatactattaaaaaatgttatgagaaaaacggagataaatatagaagacaaagtaatgagtataatacttctgacagaggtagagagcttaataaaaataggtctaggaaatacagagaaaacaattctttaaaatcgaaagctagaagctctgtaagaaccgcattaagaaatggttctctcataagacctgataagtgttcagagtgtaataaagattgcatacctgaagctcaccatcctgattatactaaacctttagaaataaaatggttatgtaaatcctgtcatgaagatactcatcataaaaaataatcacactatgtaaatgagggacatcaagcccatttaggtaactacaaacaaacctaatggtaagggcttatgaaggtatagtccgttctatatagaaatatataggctaaaacgaaatatgatattaagttcttaatgagtactgaaaactttaaagattttgagagtattcaggatactaaagtaggttggtacctagctgttacccaagaagttaaagaatctttaagattatctgatttagcttatgaggttacagatgtcggaggctatgataaaccattagaagactttaaattatggtttgttactaagttattaagattcttctcagataaaattaaagagatacagaaagaaaataaaaagattgctaagaaagagtatgatgttaaagctcctgaatataaagaatggttagagaataaattaaatgaaacagtagtagaactagatgatactgagaaaaaatttagagttagtgaattagagaaaaagtatattcaactaggtctttcacctgaaattgtaaatatgaatttagttatggataatgatgaattcataaatattgcagaacaatcacctgagtacatggggttatctgactacgctaagtcttacacgttaaatactgcaattaatttaattaatgagtatagagatgtaaaagatgtagttaatgatattgacggaggtaactttaattatgattggttccctattgagttaatgcatccatacgcatcaggagatactgatgtatgtagaagaattcattgtgatgtaattaagaaacttaaagaacaagatagacctaagtcaatgcatttattagaagttaattacccaagacttactaagtctttagctagaattgaatcaaatggtttatattgtgacttagattatatgaaagaaaatgatgagtcatacgagtctgagatggctaagaaccatgctacaatgagagagcactgggctgttaaagaatttgaagaataccaatacaatctttaccaaatggcgttagaagaacatgagaaaaagccaaaagatagagataaagatatccatcagtacagagataaatttaaagatggtaaatggatgttttccccaagttccggagaccataaaggtagagtaatttatgatattctaggaattcaattaccttatgataaagaatatgtcaaggaaaaaccatttaatgctaatgttaaagaagcagaccttacttggcaggactataaaacagacaagaaagctattggttatgcgttagataatttagaattaaaagatgatgttaaagagcttcttgaattacttaaatatcatgctagtatgcagacaaaacgtaattcatttactaagaaattacttaatatgattaataaacaaaaacgaacattacatggttctttttctgagacaggcacagagacatcaagactaagtagtagtaacccttaaattggggttgtaaaactttgttaactgcgggaagagactcgttaggtcttaactactaacttataatggaaacatatataagggcaaacagtaacgtgtttgatatagtaaaaaggttaagaatagagagaatccgcatccaagaccctgaaagtatataaaagtatgggtaaggttcaacgactaggtgttgagacaatacaatcaatacacacccacgaaagcaaaggtattatttctgtggtagggaataataaggagagttatatgaaagagatttggaagaaagtagtaggatttgaaaactacgaggtaagtaataaaggaaaagtaaggaatataaaaactaactatattttaaagccgtggataataaattccggatatgagcaagtatctataggtattgctaatgtattagtacatagattagtggctatgacatttatacctaccgacagctatagtatagttaaccatattgataataataaattaaataactgtgttgaaaatttagaatgggtaagttacaaaggtaatagtgctcacgctaataagcaaggaagattgaatacttatagtgcaagagaaaaacttagttctgtatctaagaaagccatttatcaaaaagatatggaaggtaacatcattaagttatgggattcaccaagtgaagctgaaaaagaatctaatgggtactttaaaagtactaagattagttccgttgctcacggtaaacgtaagcatcatagaagttatacttgggaatacgtatataaggattcaaagagaagtttaaataagtctattaatatgtatgatttaaataataatttattatatgaagatttgacaatgaataaaattatgggtatactagaaatgaataatcataaaacattaagagataaactaagaaatacagatgactttgttgaatacagaggatataaatttaaaaataataattaaaacctaccacagaaatgatatatgatatagtctactcaatagtgagagctattgtgttacctaaacagtaacagattgtaaactaaaaagcttacaaattatagaatttacaaaacttacctgcacacacatcagatgtaaataagtttgattacaaacatccaattaaacgttcatttgtttctagatttgaaaatggagtactgctagggtccgactatagcgccctagagatgcgtattatcggattatttactaaagaccctgatatgctacaatcattcttaaatggggaagatatccataaggctactgcaagtattgtttacaataaaccagtagaagaagtaactaaagaagaacgacaagcaactaaagcagttaacttcggattagcctttggtgaatcacccttctcatttgcaggtaaaaataatatggaagtaagtgaagcagaagaaatatttgaaaagtatttccaaacaaaaccaagtgtaaaaacttctattgacaatgtacatgagtttgtgcaacaatatggttatgttgatacaatgcacggacatagaagatttatccgttcagcccaatcaacagataaaaagataaaaaatgaaggtctaagacagtcatttaacactatcatccaaggttcaggtagtttcttaacaaacatgtctttaacttacttagatgattttattcaatctcgtaatttaaaatcaaaagttattgccacagtacatgatagtatcttaattgattgtcctcctgaagaagctaaaattatggctaaagtgacaattcatattatggaaaacttaccatttgatttcttaaaagcagaaattgatggaaaagaagtacaatatcctattgaagccgatatggaaattgggttaaactataatgatatggttgaatatgatgaggaagaaatagatacatttaattcttaccaaggttatattaagtatatgatgaatttacagaccttagaagattataaagagtcaggtaaactaacagatgaacaatttgaaaaggctactaatgttgttaaaagtgaaaaacatatttatcaagaaatttaataaaagtattgacaatatagttaacttatgttatactatataagtaataaatataaggaggaaaaagagtgaatacaggggagattagatttaatcgttctatggatgaatggattataacaagcatgtaccaggatgagctaggtgggatgaatattgttgttacattctataatagagaagaaaataaacatggttctacagttttaccaacagagtcatctactggagaagtaacagaggaattggcaagtcttgaagaagaatatcctttagctttacctttaagtagtatctcagttaatatttaaaaggaggaactgataaatggaaatacacattgattccctagattttacaaactttactattaaagatagaaatgggaactcacaagagtttgatattacagatgagttaagaattacagagtatacaatacaagaggattttatgcaacaatcagctaaatatgctttttgggcttctatattagagaaggtaagagcatattctgaaatggaacaaagaaacctagaaacaattggtagtaagctaaaccttacaattagacaagagtacgaacaacaaggtaaaaagcctactaaagatatgattgaatctagtgtttatattcacgattcttatcaacaacaacttaaagttgttgaggcttggaattataaagttaaacaacttcaatatgttgtaaaagcttttgagacaagaagagatatgatgattcaattaggtgcagaattacgacaaacaaataaaaatggtggaattactaatccattttcacattaaaaaataaagtaaagaatataattgacaaatataaaaaactatgttataataaataagtaaattaattaaaaggagaaaagataattatggatttcaatcaatttattaacaatgaggcaagcaaattagaaagcaataacagttcttttaacaataatgtagagagctacaaacctaaaaaccctgtactacgtttaggtaatattaaagatgcaaacggaaataaggttgttaaagaaaatgcttttgtacgagtattacctcctgcacaaggaacaaatgttttctttaaagaatttagaacaacaggtattaactattctaagaaagatggttctcagggattcacagggttaacattacctgcagaagagggttcatctgtccttgacccatacattcaggattggataacaaatggtgttcagttcagtagattccctaataaaccaggagtacgctattacattcatgttattgaatactttaataacaatggtcaaattcaaccaaaaacggatgctcaaggaaatgtaatgattcaacctatggaattatctaatacaggatataaagaattattagctaacttaaaagacactatgttaaaaccatcacctaatgcacctcatagctttatctcagcaactgaagcattcctagttaatattgttaaagctaagaaaggtgaaatgtcatggaaagtaagtgtttatcctaatgcccctttaggtgcgttacctcaaggttgggaacaacaattatctgacttagaccaattagcaaaaccaacagaagaacaaaatcctaattttgttaacttcttaatcaataacgttaataacacagagttaagtcatgataactttaaatttaaccgtgaaacaaatgtcttaggtgaagaaccttcagagcctaaacaagcacccacacaacaagatgtagatagtcaaatgccaagtaatatgggaggacaacctaatcagcctcagcaaggtcaagtaggtcagtatgcacaacaaggtcaaagtaatggtcaaggacagcagttacaaggtacacaacaacctatcaataacactcaatttggtcaaggaactccttcaggacaacaaccaagtaacacaggttctgttgattgggataacttagcgcaacaacaatcacaacctgattcaaacccattcaatgattttgatgttagcagtgttgatgattcacaggtaccttttgagacacaacctcaaaatacacaacaagcacctgaaccacaacaaactacacaagagcctccaaaacaaaaacaaacgcaaagtattgacgatgtattaggtggtctagacttagataacctataagatatagagtgccttagagcactcttttatttgagatataattactaggaggatattaaatggcaagagcaaaaaaaggtaaagaagtcgatttaacagatttaaatacaattgatttaggtaaagaattaggattaacattgctatcagatacaaacagagcagatattaaaaacgttatacctacaatggttcctcagtatgactatattttaggtggaggtattccattaggtcggttaacagaagtttacggtttaactggcagtggtaaatctacttttgcagttcacttatctcgaattgcaacacaattaggtgttatcactatttggattgatattgaaggaacagcagataacaatcgtatggagcaacttggtgtagatgtttcaaaactattctctattcaatcaggagaaggtagacttaaaaatacagtagaattatctgtagagcaagtaggtaaagaattagagtactggattgacactttcaatgaaaagattccgggagtacctattgtatttatttgggactcattaggggctacaagaactcagaaagagattgatggcggtattgatgagaagcaaatgggtcttaaggcatcagctacccaaaaagtaattaatgcagtaacacctaaactaaatgatacaaacacagggttaattgttattaaccaagcccgtgatgatatgaatgcaggtatgtatggtgaccctattaaatctacaggtggtagagcttttgaacatagtgctagtttacgtattaaggttcataaagcatctcagttaaaacagaaaagtgagttaactggtaaagatgaataccatggtcacattatgcgtattgaaactaagaaatctaaactatcacgaccagggcaaaaagctgaagcagacttactatctgattatatggtaggtaaagaagatgaccctatcttattaaatggtatcgacttagaacatactgtatataaagaagcagttgaaagaggtttaattaccaaaggagcatggagaaactatgttacattgaatggtgaagaaattaaacttagagatgctgaatgggttcctgtacttaaagataataaagagttatatctagaattgtttagtagagtttatggagaacacttccctaatggttactcaccattacttaataacaaagtaatcgtaactcaattagaagagtatcaagctcttgaaaactactataaagaatgggctacagataataaacaagaggaacaagaggaagaactaaaaggagaatctcaagaaaaggattctgaataatagatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttatacagattctacagtgatgtatatagaacatgtaacagatagatgggcaggaggatattccttaattagacatgaaggtgaagaagttaaagtacctaagactatccatttctctgatatatatgttaaagataaatcacacaaagtaagaataatcttcgagggggctaatccttatgaagaaagctaataatggtaatagatatgtaatagatatagatggtatacctgttgattttgaaagggatttagatagtttacttaataggtataaaaaccttagatggtcgttatatcataggtacgcagggattttatctaatgattttgaaagacaagaactaagagaatatattgatgagcaatttattaaattagttaaagaatataatattagaagtaaagtggattttcctggatatattaaagctaaactaactttaagagttcaaaatagttatgttaagaagaatgaaaaatataaacgtactgaaattatcggtaaaaaagattatacagtagagtctttaacagaagatttaaatgaagacttcgaggataatcaaattatgagttatgtatttgatgatatagaatttacagaggttcaaagtgagttacttaaagaattacttattaaccctgaaagagaagatgatgcctttatcgtttctcaagtagcggaaaagtttgatatgaaaagaaaagaagtagcaagtgagttgacagaactcagagactatgttagatttaaaataaatgcataccatgagtactatgctaagaaagaattaaataaccatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacatgaaggacaatatgcgtacaaagtagtttcagagggagaagaattattcttataccctgtacaaacagatggtaaaggtacattaaatgtaatgaagaaatcacctattgcttacactgatggagacaatatccatttcgtagtaaacacagtagtagacccttataatcactcatttatccgtactgaagatattaaaggattagataaaggtaaacaacttattcaagctttcttagctttcgttgaagaccgtttcaaatttggtgtttataacgtatttgttgcaaacaacaaagaggatgtattatctattgtagaccctacagataatgatgcagatgaagttaaagatagtttagagcacgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatatagataaggatggtaaatttggctaagttaaatttatacaaaggtaatgagttactaaacagcgtagaaaaaacagaaggaaaatcaacaatcacgattgagaatttagatgctaatacggattamcctaaaggtacttttaaagtatcattctcaaatgattcaggagagtcagagaaggtcgatgttcctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagcgtaacatcagaaggcttaattgaagcagttagtgcaggaacagctaatgttactgtaactactgaagatggtagtcacactgatattgttgctgtaacagttaaggaacctattcctgaagcacctgcagacgtaacagttgaacctggtgaaaatagcgcagatattactgtataggaggacaataaagaatggaaaagacattaaaagtttatagtaatggtgaagttgtgggctctcaagtagctaataacgatggagctactacagtatctattacaggcttagaagccggaaaaacttatgctaaaggagattttaaagtagcatttgctaatgattcaggtgaatcagaaaaagtagatgttcctgaatttacaactaaaactcctactgaagaaccttcaggagacgcataataattaagaccaactaaaaagttggtctttttttattgacaatttataatatctatgatacactatataagaattaagaaaaggaggggaaagtaatggatattccaacaatattatttagaaatccatatgattatacgaaagtaaaaaaattaatggaaaacaaagagcagtatattgtagtaaagtttgattctgtttctgttcataatttaaatgttcaaggtatgatgaatgtcatccaagattacctacacatctatggttacagagttaaagagtacggacaagaaaattcttctaaagatgatgaaagagacgttaaaggctacttatatgaaagagtaggtgagtagggtatgggaattatagtaaactccaaccatattcaatcagacactttatatgagtatgatagcttttttgatattgagaaagtagatacatttgaagaaggattgctttcaatacaggatgagccaactgttttagcaggattcatctatgatgatatcacatttaataaggtcattaattctaattcagatattgatgattatattaagaataatgatatttattatgtctctgatataggattacttcctgatacttttatcactgttgattctgatagaaaatattattcattattacaacagataactgagttaagtaaagacccttttcctaaatgggtagaggatgatgcaaaaggtttaactaagtattataactttcaagattttgaagatgtatttgatttaaatagtttttacaaaaaagaagttgacatggtaagagaaaagtgctataataatggtaatgtatatttattatatgaggttctgcctgattataaattacctctagcttatagtttactttcaaacaaggagcatggtattgttattatcggttcacagacacgttctaataatgatatactgactttttatgttaaaggtatggatgctaaggcaatagctagtatgttcaatgtagaacatgattatgattctaatattttccatacatttgtaaacagtcacattaatattttaggaaatcaaataactaagtttataagagagaaaggaagcagttatgagtaactataaaacaatagaagaagtacaagcagttattattggggtattatttaaagatgaaggtaaaattgtaacatctaagtttaataaaattactaaagagtttggtttagatagaatcggtaaagatgaccttaaagaaattgtagaggatattagacaagacgcttatctaaatgaacttaaaaacaaagcaattaaaggtaaagtaacgttaggtgatttaaaagatgttgcagataaccaagtattcgaaggtaataactaccatgaagaagtatctacttatgtagtagctaaagaaaaagaattgtctcacttaagagaacagcgtaagcacaataggcatactgcataccctcaaattatgtttgatgaacttaaagaacatatggttaaggaattacaaggggaaacattagtagaacatcacggaagtaaagctaatattaatgatacagagctaattgtgttactatcagatttccatattggaagtattgtatctgatatgactaatggtaaatatgattttgaagttcttaaatcaagattaaatcattttattaatacaacagttaaagaaattgaagatagggaaatttctaatgtaactgtttactttgttggggacttagtagaacatattaatatgagagatgttaaccaagcatttgaaacagagtttactttagcagaacaaatctctaaaggtactcgattacttattgatatcctaaatgtactatctaatgtagtttcaggagaactaagatttggtattattggtggtaaccatgaccgtatgcaaggtaacaagaatcagaagatttataatgataacattgcttatgtagtgttagattctttattgttattccaagaacaagggctattaaatggtgtagatattattgataatcgtgaagatatttatactattagagatacctttggcggtaaatctattatcattaaccacggagatgggttaaaaggtaaaggtaatcatatcaataaatttatcttagatagtcatattgacttattaattacaggtcatgtacatcatttctcagtaaaacaagaagattttaatagaatgcacatcgtagcttcatctccgatgggatataataactatgctaaagagttacatttatcaaaaactaaaccttcacagcagttattatttgtaaataaggaaaataaagatattgatattaaaacagtatttttagattaaggatggttaataaatggatacaatttttattataggtgtagcgtttataacttttgcaacatttaacatagtctttagattatttgatttatggactacagagaaaaaaatggtaagtcaaggacaacctccactaagtaactttgagtactatcatgtgatagtaccttacttagtaggtgttattgttattatactgagtattatttttagggattccttgtattccgcacaatcagggttcggtgttattattacaagctttatttacatgctagtttatgttataattggtcttgtagggtcatttgtacttacaatattccaagctagaaaagctagacagtatcaaacacaggaggataataatgaagttcaatgatatttatgagcaattaattaaaaatgatacagtacaaaacattcatgagtctcaagatgacaaaggaaatatttatacaatacagtttgataaaggtaatgataagtatttatttaatgttattaatgatggattcttgaaagaaatgacaaatggtatggtagaccatcctgaaggtcagccatattcagtaagtttaatcaataaagaaacacctagtatgtcagtgaaacaatatttaacagatgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgatacgccttattactttattgagcatgtagaagaagaaatgtctgagtatgttattgtatatgacatacatgacagagaggaaaaagaaaatcctcagaagaaatatagaatagaaccttaccaacgtacaataccgggaggaacacctcttagtaatttaattaagagtatgatgcctcaacgtaagtatcctaagaaggttacagaagaccctatatttgtagctaatgttattcctttaggaacagatacagtaacaggtaaaaccggtaaaggattttttgaaagagataaggatagaactatctattctcaaaaggaaccaactaaagtcgttcatggtcaatacacaggtgtttttataggtctaacaagtgttaagtggaatagaacatatacccccttagaaagtgttgttgagtactacaaaagggttaaaggagataggttaaatgtctaatgatgtagttaagttctatgaaaaagatattaaagaccttatcagaactaaaaaacacatgttcaaagacgatgaaataactagtgatataaacgatatacgaatcttcaatgagaaagtcatttgtcaaggtaaatgtagaacagattgtttagtgttagaccgtaatggtacagtaatgggtatagagataaaaacagaacgagactctacacaaagattaaataaccaattaaaatattatagtctagtatgtaagtatgtatatgtaatgtgccatgacaaacatgtacctaaagtagaacaaatacttaaaaggtacaaacataatcatgtaggtataatgagttacattagttttaaaggcaaacctgttgtaggtaaatacaaagatgctacaccatcaccacatagaagcccttatcatacaatgaatatattatggaagacaaacttaatgacaatacttagattgattagagaccctcatacgtatagaacagggtatagctataatgctagtggtagatatagtggaggggaaggtaatttctcccaaacaactcaaagtaaaagaatgaaaaaacctgctattattaaccaaataattcattatgtaggggtagataatacttataaactctttacaagaggtgttatctatggttataataataggtgggaagttatagaagaagatttctttaatactatgaagaatggggtaagagtaattaatgagcaaagacaaaccaaatagacgtaaagagatacagcatcaacctgttaactttgcccctacgaatactttaacaggagctaataatagtttctttgctaaaaagccttcagagcctaaagatgcaacatctgttattgaatatcgtatactatttattaaaagatttgataacgtaacaagtacagatgtgaaattacagaaaaagtatgcactaaatcttattagtgaagcacttgatgttaaagaaacttacttgtctcttaagcaaaaaggaaaaaaaacagaatctattttgcatacagatagagtttattatgttcatagaggtaaaaaacttattggaaagtgtagtatcagagaacaaagaacatttaagggtaaacatttgatatttatattcaaaacaagacatagagttaaagcagaaaggaaagataaataatgttaaaaggattttcagaacatgtagacaaacctacaactattaagaccttatacaagaccttaacaagtggtaaagtagaattactaggtgtatcttacgatagtgattacttcccttcaggtgttacagtacaatcttacattgaggatataggtaatgaagatgagggtctacagtttgttaataaggtaaatgtagtagaatcaatgaaacaggctgtagtaggtatgaataatcaattaggttcttcaggtcttggctatgtgagaactgaacaacttaaaaaagagttggaagagactggactaatgacagatttacttgctagaggtactaacttaacctctactaagaaagtagatattgtaagtacttttattgagcctgaggtaacataccaaaatattactatagctaaagatattaaactacgtttgtataaagtagaagaagaatcaccattaaatggttacactcatattgtatacttacttactacagaaaaactatatgatggtcaaacactcttcggtatgctctctaaaaaagataagttatctaaaggagatactgataaattattagcattcttcagaaacaatagtttaataagtaaaagtgtattttgtgttaagttattaagtaaagactactactttaatttatataatacacatgagacagggatattctttttagaagacacagatgttattactattgcttgtggtcagtcatatgttaaagttaacactaaagatattaagtctagttatgttaaaattgaagataagactcataaattaactgagctagtaattaacctaaagggtgacgacacattaactattttattctaggaaaatgttataaatatgtgataattaagtataaatatacgttatataagaagttttcataatgtttttaatacagaaactagttaagttttttctacttgctctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttaagaaataaaaacagtgatataaaagttgttcctgataaagaaaaagaaagtatattatctaagttataccataataagttactacgttcaaaggtagataatgcattagatgaagatatgagttatgatgatattatagaattatgtaaagaatatgatttagaattgtctaaatcagctattacaagatataaaagtaaaagaaaagaagctattgaaaatggttgggatttaggagaattaattgataaacgtaaaaaaacaagtgtaaaagatattaaggaaaaagaaactcctatattagaagaggagcaactttctccattcgaacaatcaaaacatcacacacaaacaatttatgatgatattcaagtactagatatgattatttctaaaggtgcaaaaggattagagtttgtggaaactttagaccctgctttaatgatacgtgcaatggaaactaaagataagattaccggaaatcaattaaaaggtatgtcatttattggacttagagaattacaattaaaacaaacagctcaagatacagctatgagtgaagtattattagaatttatacctgaagagaaacatgaagaggtattacaacgattagaagaactacaaaatgaattctacaaaaatctagatttagatgaggaaagtagaaaattaaaagaagctcttgatagagtaggctatacaatttagatagtgaggttagagtaatggcagatgagattagtttaaatccaatacaagatgctaagccaattgacgatatagtagatatcatgacatacttaaaaaacgggaaagtactgagagttaaacaagacaaccaaggagatatccttgttagaatgagtccagggaaacacaaatttactgaagtatctagagacttagataaagaatcattctactataaaaggcattgggttctctataatgtatctgttaactctcttataacatttgatgtttatctagatgaagaatattcagaaacaactaaggttaagtatcctaaagatactattgtagaatatacaagagaagaccaagaaaaagatgttgctatgattaaagaaatacttacagataataatggtaattatttctatgcacttataggggaaacaatgctctttgatgaaaataaattaaataaagttaaagattagggttgacagctcctatagtttatgatatagtatatgtatactaaaagtaaaggagctaacaattatgtttatttcattaaatcaagaagagaaagaattattaactaaagaggaaagtaaatacacaccattagaaacatcaagagagtttaacacacctaaagaagaattcattgtaacaagctataatgaaggtaaacctttagattacattgcaaaagaagctaaggtaagtatgggattaatttacacagttctaaactactataaagtaggtaagcgtaataagaaatcacctgtagaagaaagaattgcacatatcttaaaagataaaaacttagtcaaagagattattaaggattaccaatatatgaatttacaggacatttatagtaaatataatcttcataagaatggtttatattacatcttagatttataccatgtggagagaaaatctgaacttaaggacaaagcattagaagaggataatattgtcgttgagtaagtaaagaggttataatatgagaaataaaaaatcatttcaagagcagttaaatgacatgcgtaataaagagaaatgggtatctgaagaggagttcactgaagaagtggctcctcctgaagaacctgaagtagaagaagaaaaactatatactttaaatgagttaaaagagagcttactagatgctcaaggattaaaagatgttgtagctgattttcctgcatctaaagatttatatgaacctaataagttatatatctgtacaatacctaaaggatatcagtctaccgaagtacaaccaggacaatatattggtattagtactggattattatcagagtcagaagacttcagccatttaagaggtcaaatgcctagaaacttatatgaaacttctcatgttttaaaacctttgatacgtattaataatacaaatattgaataccaacaacatgagttacttgaagacattaaggatgacaaaaagatatatgatgtagagttagaagacttaagattagcaacaggagaagaagtttctcatttagaaattgttgataataagttttttgaaagtcgtattaatgaagttcttgaccgatacactgaactaacggattccaatgatttacttaagtactatagtaaattacgagaattagtaggtagtgacaaaatgatttattgttcactcctcgataaatgtgttaaaattatagattaatagtagtctcctcttatattataattgtaagaggggacatttttgtatagaggtgttaattatgtcaagaaaagcaagtatattctatatactagtggttattgttttggctttctctatctcatcttattatatatcttctttcatgtatcacgacaaagcaaaaaatgaagtctctactgagttatcgaacacaggaaagattaaagaagaaaagaacgtagaatttgtcggtgactacacattgaaaaaagtggaagataataaagcttattttatggaaacattacctacttacctaccaggtagaacaggagataacagcatagatatgaggtactacaaaacaagtagatttaaggaaggggtaaatttcaagcttattagggtatatactgaagatggagaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaactatggaaatggcagatttagaaagatttgatgcatttgtaagactaatttcagatgatgagctttcggaggaaagaatactggagttaagcgtagacttactaaacccgatactagaaggaggtacagcttacaaggctaaaaaacgtattaagagtaaatttggtaagttagaagcaaaaaattttaaacgaaactataaattcttacttaagtcgatagctcaaatagaccaaaggagataggacaatgacagaaagggaaaaattaattaaagatattgaagaggctaatagagacatacagttacagttaaaagaagtagataattataaggacagcatacgttctaaaggaacaagaaattatatttctacaaaggtattagattctattatggttggtttcatagttagttttttaatactcattataatgcgtgtacttgaatattttgtaacaggtaatgctgtttactcacctttagcgcctgcagttattattatgtttgttttagcactaggtacatggaaagtaagtaagatgaacaaaatagtatcttatagaggaactattaagatgtactgggaactaagtaatgctgagcaaaaacaagctaaggtatttaagtatcctaatgatgaagtagatattgtatcaaaacataacttaagacaaataacttttagtgagattaatatacttcatcttaaatatatgagatataataaggcagtagaacaacatactaaattatctaaagaactttttaaaaaagataaagaaactgttgacaagaacaaataagtgtagtatagtattactaaaggaggagagatattatggttatacctagtattaaagcacaaaacaaattcaagaatgagttagagtattataaacaaggtcacattagtgaaagtaaaatgttagaattagcttttgattacatccaagaattagaacaaaataacgaatacgttactaacttgctagaagaggagagatatggtgagtaaatttatcggagtgtacttatttaatttactaatagctattattttaactttaaccttaataggtactattactgactcaattgagagtactttagcccaaataatcgtagggatgttcataatcattactatatatggaatcctatcagcgttaatacctattctagttcataaagctgtatcaccgggatggagctatactgaatggaatgaatcctattacatcagattacctggagaagagaactacaagtactatagtaaatggtatttagatttattaggagttaaagaattttactataagagagacaatggagaagaagtaaaagaaaaaaatatatcatgggcttttcaagctgaagtaaaaagacctgaagatgttaaccactggaaaaaccaattgcttactaatagacctttaacaattttagaatataaaaaattaaagaaattagataaggaaagtgaaattaggaaacaagaagatttagaagaatataaacaatacaatagtaattaaagaggtggaaagcaatgataagctcatttgatagtatactacttgtcatatacattattatagcttttgcagtagctatggcaattatctacttagtatttaaaggtatgactattctactagataagctaatgatgttattattaagtaaaactacattagatgtagaagcttgctctatgataatggcagtcatcagtacaattgtgtttggaattattgtacttttaatatggctagcagtaaataatattttactataaggagatttactatggattttaatgactttataaacagtgaatcggatagggtaggtaagcctaaacaaaagaagaaggtagagaataagctaccttcttctactcctattgaagataaggaaaagaaattaaaagagataagaaagaaatcattatatattgatttaaggagaaaaagaaatgactaaagaaacaaatgtactttacaaagataagtatagagattatactatagttgtaagattagcagggaatattattgttactgaagtagataagaaacataaaacagcatttacacctattatatttgacaatggtgtagaaggcgtagagcttgtaatgcgtataggttctgtagagcttaacatgacagatttacgtgagttcacaaaagaagtatctacggctcagaaagctttagaatattttaataaaaaactttacattaaaggcttgacagatgaagcattttaatatatactaaaagtataaataaaataaagaaaagaggaatgattattatgttattaggaattttatggtttatatggggatttgtatcatactttgtattgatgtttggaattgagttttggaaagatagatggatgccaggtgttatcggagcaggagccttactactattcttattttggattatgaaatctatccataatgctatgacagtagtatacttgtattaggaggttgtatagatggatatactaattattcattataaagaaacaaataaacgggttttaaaagaaacaatacaaacaatacaaaatcatttaaatgatgaacatggtttggttaagatgacagcaacaaaacttagcagagagaatatagagaaaagatttaataactataatatagtcattgcagaagatgaccctgataattcttatcattacggtgaagctgtagaagacgcagattttattatagacataccaatttcatatttagatatacatgcaggaatagaatgggatgttgataatcctgtagatatgctagataggaatcctgattttatagaagctgtaaataaactaaatgaagacttaatgttataaggaggaaatagaatgctaaatgaaaaactaaaaaacctggaagatacaaaagtatacatgattaatagtattgcaagtttactaagcgcaagtacaggaaaatcaagtaaagtattttttgatgaagggactattaaaattgtaagtggtgaaacaaaagcagtagaagtcattgataacttagttcaccctcactcaggacgtttacctattaaaacaacagaacgtattgcgctaggtagattaacagattctttacagtttgttatttcagaaatagaagtagttaaagaccaaattatagatgaagaaaatgaagcttacattgattttgtgatggaagactggaactgggattaatgcctatggacttattaactattgcttctgttgcttttatagctgtagtcattattgatttgattaatgatgatatgagctatatgcttactggtactgcaatcttaataaatatttgggcaggattttatggatggtttttcttactgcaagcaggaatgttacttttcttactattagctaggaaagttaaagatgataaggagtcaatactatattccagtgcttcattaatatgtgcactaggaatgataataaatcttctttcattttcttaaaaataagtattgacacctttgtacttttgtattatacttagtatataacaagtacaggagatgattactatgagtaaagaaacaattagaagacaattttcaaatgcaattgagattatggcaacaactaaagaatggtggaacttccctaaaagttttgatacgaataaagaatttaaaattaaaacttttaaaaatgatacacttgtatttgaagtcagagaaggcagtagaaatttaggaagctttgtagtttttacaaacattgattttgattatgataaactagaaggaacttcaacacaatatatgattaattactttgctaagaaattaactaaagatatgtttaactatcataaattacaattatagtaggaggtggaaagatgagagaagagttaaaaccttttaataggaaacaagttaatgttaagggttacttagatgatgttaagtattcaaagcgtagaagacataaaggtaatcaacatgggtgtgttaaaatcacagttactgatgtaaagattaatggtatacctattgaccacgttaacattgaagttagtatctctttctatgaaaaactaaaggagcttcaaggaaagagaattcaatttgtaggtactgtttataagtatgttaaacatgctagggggcgcaaaggtagaattaaaggattttataaagaggattatagcgtaactttagataagaagttacaaaaggaggaaaaataatgattaaaagaagaaaacatttagaccactcattacagcctgagaaaggatggagaacagtaccttttaatgggtattatgaagcgcatcctacgggtttaattagaaataaagtaacgaaaaagttaattaaaggtacacagacaagaaagaaccatcctaagtggactgctcatgagattgtatacctaattaaccctaagaaaacaagttattctaggggagtagttattgcacatacattccctgaaatgattagtcaatcacgaggagaccttaagaacggtcatgtgtgttttaaagatggtgaccgaagtaattgtcatgtagacaatatgtttattggtaaaggtaatgttaacaaaaatatctataaattaaatgattcttatttaactagaaaagatattgaagaggatgttaataatttagttaatgaaagattattctctcaattagaattattgattaagaaaaatgaaccggaaagaattacacctagtaatcactttattaaaagagataataatgtgttcagtatcacagatttatctaaaaactcactagtagagtttgagttagaaatcaagaatattaagtaaggtggttatataaatgaatgagtggtatgctttatgttattataacaaaataggtaaaaagaaaatacctagacaaattaaagctcacagggatgtatctgtattagaggatttaaaagatagattagaagaacaaaatcctaaagaagaatacaagattaaaacaacaaaagaatttgataaggaaagataattaatgttaacacctcaacaaaaggattcattaaaagagcaacaaaaaaaattaagtaaaaagaagaaataagtcttgacaattgagtatacataggttatacttaagttaacaaataaagaggaggtatgacctatgttattcgtaatttttatattggcagtactgtttgtacttggatttatgaatggatggaactcagaagactagataaggagtggttgtaatgaagttagaagataaagtgttagagagaattgattctcttggaaataaagcaggtaacttaagtaatcaagtaatggagtcattagtaaagtatcaaattacgtacggtattatagatattgttgtaagtattttagttattgcactaacaatatttttaggtaaggtttaccttaaagaatataagaaggttaaaatggatttaaaagaaagcttattgtatgatgattacgatgacttaagtggtatcggatggtgttacacaattctattaatactattaacgttattctctctttacgcaatagttgcaggtatcccaactgatattatgagattaattaatccggaagtttatgcagtaaaagatttaattgagcaagttaaaggaggaaattaaaatgaaacaaagagactttgaatttgaagaggattttgtattaacttatgagtgtgaggattgtaagcatttcgaagactggggtcatgatgaagagcctgaagaatgtagtgaatgtggaagtagtgatttaatcaataatacaagtcatgaagatactgagtgtgatatgtgtcgagggtatattgatatgtggcaagatggatatagatatatgggagataataaagagtatattgaaaaagaggaatcaggtttgatttgtgaagattgttatgagaaattagatatttaataaggaggaaattaatatgaataaagcagtagaacaagcaagtaatgcattaggtcaaggattttcagctatggtatggcatcaagtattagtagggttagggtttattttattaggattggtattatctttactggtttgggtattagtaaaaaaattccatgtaccttttaatcacccgacagcttttgtagtgtactcaattatgttagtgagtattgttgctagttttatttggggcggtttacatgtaattaaccctgagtattatgctattttagaacttaaaggttttataaagtaggaggaattctatgactaaagaagagttagagcaaaaagtaaaagaacttgaagcagagaataaagagcttaaaaaacaaatagaacgttttgaagacgaaggaggaaaaacaaaagatgaacagtagagaaaagaaaattttaacactaacagtaaataattttttaatgttagctttagatattgtagcacttgttaggtacaagaaaggtaaaattaagcaagagaattataacacaggtcaaatttcaagaactatagttacaacagccaactcattaggtattctttacctagaagagcaagaacgtaaagaaaaaaaatctgttaaaataggtactcttgaaagtggtactctaagagggtttaaaaataaataaaaaagtttaagaaacctattgacattaggtttcttttattatatactaagagtataagaaataaggaggttaatttatgaatggtattattgtattttacaaagaagaaaataaacatattctaaagaagctcttagaattcattaacacaacatcaaaaggattaacttacaccttagagggtacattagttgataatgatatcgttttacttaaagataacaacatatgtgattataacctaagacagtttagtaagacaaatgatggcttagttataggtctattgagtgaatcatataatgatgttcattactatgaaaaaggagatgcctacggtatagaaagattaactatgtatttagaggagatgagtcaataatggtaattgcattttttattttaggtctattattagtattatgtttagttggtcttgctattattaaagtactagaagcaaggctaaagaaaaaagaactaaggagagaaagagaatcttttggtattcctgaaccagggagaaaattagggcacataggatatgtcgaaagtaaatatgctttaattcataaagaatcaagtaagataataataagcgcagagaaaagtaaagttgtagaaacattacagaaaatgtataatttagagttaacatctgtagatgtttctagtgtaacgggactctctcccttaggtacaggacgtatggagaatatggtattgctttcatacaaactagaaagagaatgactttataaattaattgaacttaataaggagtgatacaatggaatttatagataaaaataatgtaattaaagcttatgatataccgaatgtttacttaaaaggttacgtattgtatgcatgtgataaaaatggagacattacaacctatgatgggtatgaccaaatacactataaagatggtagagtattaacattcccttttgataagccgttaagaaagataaatgtactttcaggatattacaaactatttaagaaggaggacatactatgatttattttgttagtgatttacattttggtcatgataatattagagaatttgaagcacctacaagaagtcattggaattcagtagaagaaatgactgaaggtttgattgaactatggaataacacaattacaaataatgatattgtttataatatcggagacttcttctttaatatgaaaccatctaaagtagaagaaatacttaatagactaaattacaaagagatgacattgattgcaggtaatcatgaccataaaaagcttgttaagctatatgaacgtaatggtatcacagtgaagtatgctgatatgcttaagaaggaaggtaaaagattttatctgagtcactaccctacacttattggaagaaagaatatgtttaatattcatggtcatatacattcacaactaatggatactgattaccacattaatgtaggttatgatgtagaaggaaagattgcatatagttttgatgatattctaagtatagcaggtgagtatagtggagaaattcaaaggtaaagacttatataagactagaattagaaaacaaacaattaaaaatttaattattaaagtagagaaattacataataaacatagcccttatcaacctattggtcatgtttattattaccctaaaacaaaagagtttactttatctaaacccgagcaaaagatatttatagagtatatgaaagaattaggttttaatgtaaaacacaagagacgtaagaaaacacttattatttataagaatgcattcactgaatacattagtaggtatcatgaagcaatagagcagattgaaggagggaaataatggaatatttatttttatttataggtattggcatgataatttggggtttcatagcaccttatcttgcatttgtagtttactataaacatgtaagagaaaatcataatggattcagtgatgaggaatctctagaagaggctatagtatttggtatgggattcatgtttatagcatttattcctataggtatactagttgtaattgaagaaattaagattttattcttttaaatgttgacagctacaatatagtgtgttacagtatagaaaaggaggttaattaatgaagcattttattttaattttaggaattgtaatactagttattgcattaggtattgttttaccggcatggattttacagttagtactatctgcattcggagttaaagtaagtatttgggtatgtatcggaatatttattttaatcagtgcaataggaagtatgtttagcagaaattaaaggaggaactataaatggcaaaatatgaatcaaatattaatggagagaattatattgcaacaccgtcacaagctttaagagaggcactagcaaaattaataactgaagaaaagagctttgcggagtaccaaactaaaggtgaggagcagtatgaatcacagttacaactaagacactttgatacaatgatatctcagtatgaggaagctattagagtactagaagataaatatagacctcagatttttattccgaaagataataaggaggaaaattaattatgaaagcagaatcaatagcaagattttttaatgacaaagtactacaaatagagggttataaagtaagattcttacaggctagttcatcgtatattttagatatagatactatagatgaatcagtattgtttttagaagctcaagtatctacactttcaggtaaacatttattagatacagctattacaattgagagacctgaaacattaagtgctaaagagctatatacagaaattagtaataaactacaagctattgtaggagaccaaactaaaacaactatagaactatcaagatattttaaggaggaaaaataagtgtctaataaaaccattacaaattatttattaaatttagaaggaataaaaggagaaacgtatagtattattgctcatatcaataaacaaactggttggggtgataaaggggattattttgaaataagcataagttataaagctgataaagaccctagaacaacgagatatattacaactgaaatttttgttgattatggtagtaataatccaaaagaaattttattacaattaagagataagattttttctattgtagaagaacaggtagagactgacaatgattttattgaatctattaaagaaattaattcaactaaagaattagaaaaactaaagccttatatcaataatgaatattattcaatgtttaaatcttctattgaaaaggaaatacctgtagctttatcttctgaagtactcaatagatgtacaggtaaaacaagcacattagcttatttagcactagaaaaggatttacccttagtagtatcaaatgaacctatgagaaaaatgcttaaaaataaattccctcatcttagagtagcttctgctgaagattattcaaattatgatattaaaggtgaaattgttctaatagatgaagtagatattgaccagttatatagtgctgataaagtatctgttgatgcacttttagtgggtatcattaaaaattaaataaatttataaatacctgttgacagcctgttgacagcaggtattttttatagtatactttagatataaagaaaaaggaggtaatataatgatacccgtaatagttatacttattggactcatattatttttatctagcggttataagttggtattgggtaagtattatgatgatgtagatttaaaaatactatttaccatatttggtgttgggattgcattactacttggaggatttatattataaagcaggagctattttattttaaggagaggtaaatatgaattatagagattttattacagattgtattagcggtggttacaacgtacacatcagtgttacagaaaaacgagtacacattatttctgagatgacatcagcatcttaccctaaaaaggaaattaacttagatgaactacaagcttatgtgtactatatgaataattttggaagtcaaattacaacggaggggttataaatggaattggttattaatattgtagcagtattggttggtatgtatgctatttatttctatgttacaaagtttagtactggcttatcaggtattttaattgttttagggatggctattggtctttacttctacttagactatttaaatgtcagagaaaatgttattcgattagtttcagtaatgttcggagctttcttatttagtattgaaatgatttataataaaattatgttcgaaattaaaaaaagcaatgttcagaagactgttagagtgtatgataaagagcagtaatgattttaccataagagtacctaaattactttaagtgctctctatggtaccttaaagtagcttagaattgaaattaaggagatgaacaattatgtatcctgaaatagatgtggaagaattagcgtataagctaaaaagtacaagagagtatttagagagcattacaacaaaagaagtagaaatttatgaaatctatcatcttaaaacaggtaagttagtttttaaaggtgaatacattgaggtaaaagaattactgaggaaaatgtataaagaaaatttaacacttgtagatgtagatacaatgttaagcattggtaaaggatttattgatgtaattaagaatatatcggcagaaaatgtattccaaataacatataaaaaggagctatcaacaaaatgattaaaatattttcagaagtagataaagaatacaaacctattattactgaaaagtttcctaatggtgagattaattttaaatatgatgatttaaagtatttagtagaagaggacttaagatttgatgttttctttaaatgggaaaatgacgcagacttaatgcatttgtatatgtttactaagtatttagagcaactaggtattaaagataaagctgaatttttagagattgcatatctaccttatagcagaatggatagagtagaagaaggacataataatatgttcagtcttaaatacattacagaatttattaataaccttaattataaatcggtatgggtagcagaacctcatagccctgtaacagaagaattacttactaattcttttgctattgatgttacacttaaattattaaatcagtatattgaaatgtccgaagagcctgtaacaatagtactacctgataaaggggcatacgatagatatctatttgatgtagaacgtatcttaatggaatctaatattgaatcatattcaattgtatatggtgagaagaaacgagattttgaaacaggtaagattaaaggtattaaaataattaaagataaaaatactttatatgataattgtattatactagatgacttaacaagttacggtgggacatttgtcggttgtaaaaaagcccttgacaaacttaaggtaagtagtgtatcattaatattgactcatgcagaacgagcttttgcagaaggagcattacttagctcaggatttaaagatattattgtaacagactctatgttccctaaaaataattgggaaaaagctattgctaaacatagagctagaatcaacggaactgaattacaaataaaagatatcgaaagatatttataaaaggagaaaaataaattatgctaaatccaactttaatgtgtgacttctataaactaagtcacagagaacaataccctgaaggtacagaaattgtatatagtacactagtacctagaagtaataaatattatgaacacagtgataatattgtagtatttggtattcaatcacttgttaaaaaatattttattgatatgtttaataaagagttctttaacagacctaaagaggaagttattaatgaatacaaacgtacagttaaatttacactaggacaagaaaatcctgatgctaaacacttagaacaattacatgacttaggttatttacctattgatgtaagagctttaaaagaaggtactgttgttcatcctaacacacctgttatgacaattgaaaatactcactcagatttcttttggttaactaattacctagaaactattattagtactcaaacatggcaagcaatgactagtgctacactagcatatgatatgcgtaaaatgctagataaatatgcaatggaaacagtaggtaatattgaagcagtagatttccagggtcatgactttagtatgcgtggtatgagttctttagaaacagctcaattaagttcagcaggtcatgcaattagttttaaaggtagtgatacagtacctgtagtggatttcttagaatcatattacaatgcagacgtagagaaggaaatggttgttgcttctatccctgctactgagcactcagtaatgtgtgcaaatggtaattatgaaaccatggatgagtatgaaacatataaacgtatgttaacagaaatatatccaacaggcattttctctattgtgtctgatacttgggacttttggggtaatatgactaaaactttacctagattaaaggatattattatggaacgtaatggtaaagtagtaatcagacctgatagtggagaccctgttaaaattatttgcggagaccctgatgcagacactgaatatgaacgtaaaggtgcagtagaagtgctttgggatacatttggaggtactgaaactgaaaaagggtacaaagtattagatgaacatgtaggattaatttatggagactctattaactatgaacgtgctcaacaaatttgtgaaggattaaaagaaaaaggttttgcaagtattaatgttgtattaggtgtaggtagtttctcttaccaatttaatactcgtgatacccacgggtttgcaatcaaagcaacgtatgctaagattaaaaatgaagaaaaacttatctataaaaatcctaaaacagatagtggtaaacgttcacataaaggtcgagtagctgtatataaagacggttcatgggaagataacttaaccttacatcaatggctaaacaaacaaaatgttaatcaattagaaagagtatttgaagatggtaaactttatagagaccagtcgttaagtgaaattagagaaataattaaaaataattaataaatatttaaactccctattgacaaagggagttttttattatatagtagggctatagtaaataaaggagtgaaagaaatgatttataaaatatcaaaacataattactatagtaggtttgaatattcatcttatttacctgatgaaggatttgcatatatagattatgtagatgtcattcttataggtgtagataatccaaagaagagaaaagttattactttaaaagcagatgagtttaatcctagtgattttaaggttggtcataaatataatattataaaaatactatggtttgagaaatgggaatggttacagccatagggaggagaggtatacaatgattatagataaattaaatggagttaaattagagattggcggtcatgttgtatcatttagtgtaagtaagtttaaaacgattaatggtgaaagacaattacttgattaccaccatatcaaaagaggtaaacagagatattttagaactactgaggaattctataatgagtacaaagaaataaaaccggataagaatgagatagatgaaatgtttgaatctttaggttacgtaaatactgaattagaagatgtagtaagaaaccaagagaaagtgacagagatattaggagttagtgaacagtatttaaaccaattgtcttataaggctatagaggaatatgtagaaaaaatagttatcttagaaattaaagaattaaaaggagagatacaatgataaacattaatgtaactgaaaaagaaaaattagttgtaggtgatttagtaaaatcaagagaagatggtacatggggtattgtagtagaagataagcaagacttaaatgtagttgtgttaaatgacgagccctggttattttataaatcaggaattaaaagagtagaagggcaattagaagaggactttaaatttattaaaaacagagaagagtatgatatagatgtagttaattcttcttataaataaattcacatctacctattgacttaggtagatacttattatataatagtatacaaggagatgaagtatgatgaatggaaaacaaatttatgtatttttaagtgaccaatacagtaaagatatactcagtttacaattaggtcttattaaggaatggtctaggagagaactaacttattcagatgatgtcggttcagatgcagatgttgttatttgtactgatatagtaagagatgatttcgtaaaaaaactaagtaaaaataatagcaatgcattatttgtatttattagttctagttattggataggttataaaggcggagaattctttgttgcagttcaagactatgtgaaaggtatgtaagatatgaaaaaattattaatattatttacattagctagcactttactattagcaggatgtacaccggataatcatgaaggaaaagttttaggaacaggagaatatagagagccaactacttatatcaagtcaggaagtgttactgtaccagttattggtgaaatgaaatactatgtagacttagaaacagataaaggtgaagaccgtgtttatcttaatagggaagtttatcgtaaatttgataaaggtgatgatttctctaatgtaggtaaaaaagtatataaaaatgatgaattaatatataaaggggactaattagtatgaaacaatttatacatgataaaaaagatagttataatagtacaaatcgtaattttgatattcaatattataaaggtatacctttacaacaaattgatagggggtatggtcaagcaagagctaggagatttacaataaataatacgaaccaaaatatatggatacctatgacatatttaaaacctaatggtactcttaaaaataacattgatatagattggatacttgttaaagaaaaatgtagtttaaagaaagcaggattagtaataaaaatagaaattacaggagatgtattataatgtatatattagaaagaacaattagaggttttgcaggtcaaacagaagatattttaccttaaaggagatgaattaataatggagtatgaaaaaatgattagagaaataatggtaaactctaaagaaatgtcactagaagataaaaaacatttaatgagtttattgatgagtgcttatggtgacttatcaatactagtagcttttgaagaagaaaacacagcacatatgtatgaagaaataaaacagtatgatactaaaaagttactgaaaccaagtatggtaagtaaagataattatatgaaataatatgtaaccaatcaggaggaataactaatgataaatatagaacatgattatacaataagaactgtagataatagaaagtatacttactatagtaaacatgaatccccagttactttatataaaaatattataagtaaagattgtattgaagtaactaaatatgggaaagataaaaaagttattatagctactaaatatattgtatctattgaacgatggtaattacaaggaggagtagttatgaatgctagggaagcacgtaaaaacactaaaaactataaggactctaatgtagtaactaaagagcaacacttaacttatatctataataagataaactacttgattgcaaatagtagtagtcagggtaagacatatgtggcaatgaatctaagaacagattatcctgatgagttttctttatctaaattaaaatatctaaaagaaattaaacagcactataaagacctaggatttaatgtgaaaacgcaagtaagaaaggcaaagtggtcagagaaaagtgtaatcaggtactactttaacttaggctatatagacagcgtgttagtacctattatacacattagttggtaattacaaggaggaatagttatgttttttaaaaagaagaagttaagcaatgtagagaaacaaataagacaaaaccgtaataaagaagacaaagaaagaaaagaacatcaagataagttaaatacagatatgtataaaacgtatgaattagataaaattgtagaagaacatttaagaaaattagacaatatatcccttgaaggattagaactaacttcagtgtgtttagggacaagacttgtttattattattcaataggcaaggattgggataaacaagtatatagtttaaacgaattagaatatatgaagaagaaatttaagaaactaggatttgaaactcagataacaaacgaagatataggatttcaaccttatatttatttaagattattatgggatgcataagtaattattattagaggaggaatagttggtgttgcacagttaattacggattatcatgacggacattaagtattgaatattgttgactaataataagaagaaaatattattactactaagtacctttgttatgtactactattactactactaagtacctttgttatgtactactattactactactaagtacctttgttatgtactactattactactactaagtacctttgttatgtacttgtactactattactactactaagtacctttg

SEQ ID NO: 16 - protein, 20 aa, Artificial Sequence
  Description of Artificial Sequence: Synthetic peptide
KQFQNRSEQTTAKERFIVEV

SEQ ID NO: 17 - protein, 22 aa, Artificial Sequence
  Description of Artificial Sequence: Synthetic peptide
MVFTLEDFVGDWRQTAGYNLDQ

SEQ ID NO: 18 - DNA, 136 bp, Artificial Sequence
  Description of Artificial Sequence: Synthetic polynucleotide
aacaattccaaaatagaagtgagcagacaactgctaaagaaagatttattgtagaagtttaaaggaggatgattatttatggtattcacattagaggatttcgtgggagattggcgacagacggcaggttataact

SEQ ID NO: 19 - protein, 17 aa, Artificial Sequence
  Description of Artificial Sequence: Synthetic peptide
VTINGVTGWRLCERILA

SEQ ID NO: 20 - protein, 22 aa, Artificial Sequence
  Description of Artificial Sequence: Synthetic peptide
MAINFKGSPYLDRFDPSKDRTK

SEQ ID NO: 21 - protein, 22 aa, Artificial Sequence
  Description of Artificial Sequence: Synthetic peptide
DNKQFQNRSEQTTAKERFIVEV

SEQ ID NO: 22 - protein, 20 aa, Artificial Sequence
  Description of Artificial Sequence: Synthetic peptide
MVFTLEDFVGDWRQTAGYNL

SEQ ID NO: 23 - DNA, 146 bp, Artificial Sequence
  Description of Artificial Sequence: Synthetic polynucleotide
  modified_base (144)..(144): a, c, t, g, unknown or other
gataataaacaattccaaaatagaagtgagcagacaactgctaaagaaagatttattgtagaagtttaaaggaggatgattatttatggtattcacattagaggatttcgtgggagattggcgacagacggcaggttataactnag

SEQ ID NO: 24 - protein, 4 aa, Artificial Sequence
  Description of Artificial Sequence: Synthetic peptide
CCFE

SEQ ID NO: 25 - protein, 9 aa, Artificial Sequence
  Description of Artificial Sequence: Synthetic peptide
LVGDCANVY

SEQ ID NO: 26 - protein, 12 aa, Artificial Sequence
  Description of Artificial Sequence: Synthetic peptide
LNKEREIILNGN

SEQ ID NO: 27 - protein, 6 aa, Artificial Sequence
  Description of Artificial Sequence: Synthetic peptide
RFTLFR

SEQ ID NO: 28 - protein, 26 aa, Artificial Sequence
  Description of Artificial Sequence: Synthetic peptide
VVSSDNKRSDWLEIVRTYISLIKKGR

SEQ ID NO: 29 - protein, 19 aa, Artificial Sequence
  Description of Artificial Sequence: Synthetic peptide
MAINFKGSPYLDRFDPSKD

The invention claimed is:

1. A recombinant bacteriophage nucleic acid sequence, wherein the nucleic acid sequence between position 70,285 and 71,657 of SEQ ID NO: 1 or the nucleic acid sequence between position 79,551 and 80,923 of SEQ ID NO: 2 is replaced with a heterologous nucleic acid sequence comprising an open reading frame that encodes a reporter protein, wherein the reporter protein is a bioluminescent protein, a fluorescent protein, a chemiluminescent protein, or any combination thereof, wherein SEQ ID NO: 1 corresponds to non-recombinant bacteriophage K genome sequence and SEQ ID NO: 2 corresponds to non-recombinant bacteriophage 812 genome sequence.

2. The recombinant bacteriophage nucleic acid sequence of claim 1, wherein the open reading frame of the heterologous nucleic acid sequence is operably linked to an expression control sequence that is capable of directing expression of the reporter protein.

3. The recombinant bacteriophage nucleic acid sequence of claim 2, wherein the expression control sequence is an inducible promoter or a constitutive promoter.

4. The recombinant bacteriophage nucleic acid sequence of claim 1, wherein the fluorescent protein is selected from the group consisting of TagBFP, Azurite, EBFP2, mKalama1, Sirius, Sapphire, T-Sapphire, ECFP, Cerulean, SCFP3A, mTurquoise, monomeric Midoriishi-Cyan, TagCFP, mTFP1, EGFP, Emerald, Superfolder GFP, Monomeric Azami Green, TagGFP2, mUKG, mWasabi, EYFP, Citrine, Venus, SYFP2, TagYFP, Monomeric Kusabira-Orange, mKOκ, mKO2, mOrange, mOrange2, mRaspberry, mCherry, dsRed, mStrawberry, mTangerine, tdTomato, TagRFP, TagRFP-T, mApple, mRuby, mPlum, HcRed-Tandem, mKate2, mNeptune, NirFP, TagRFP657, IFP1.4, iRFP, mKeima Red, LSS-mKate1, LSS-mKate2, PA-GFP, PAmCherry1, PATagRFP, Kaede (green), Kaede (red), KikGR1 (green), KikGR1 (red), PS-CFP2, PS-CFP2, mEos2 (green), mEos2 (red), PSmOrange, or Dronpa.

5. The recombinant bacteriophage nucleic acid sequence of claim 1, wherein the chemiluminescent protein is β-galactosidase, horseradish peroxidase (HRP), or alkaline phosphatase.

6. The recombinant bacteriophage nucleic acid sequence of claim 1, wherein the bioluminescent protein is Aequorin, firefly luciferase, *Renilla* luciferase, red luciferase, luxAB, or nanoluciferase.

7. The recombinant bacteriophage nucleic acid sequence of claim 6, wherein the bioluminescent protein is nanoluciferase.

8. A recombinant bacteriophage comprising the recombinant bacteriophage nucleic acid sequence of claim 1.

9. A recombinant bacteriophage comprising a nucleic acid sequence selected from the group consisting of SEQ ID NO: 5, SEQ ID NO: 6, SEQ ID NO: 7, SEQ ID NO: 8, SEQ ID NO: 9, SEQ ID NO: 14 and SEQ ID NO: 15, wherein SEQ ID NOs: 5, 8, 9, and 14 correspond to a nucleic acid sequence in recombinant bacteriophage K and SEQ ID NOs: 5, 6, 7, and 15 correspond to a nucleic acid sequence in recombinant bacteriophage 812.

10. A bacterial host cell comprising the recombinant bacteriophage of claim 8.

11. A vector comprising the recombinant bacteriophage nucleic acid sequence of claim 1.

12. A bacterial host cell comprising the vector of claim 11.

13. The bacterial host cell of claim 10, wherein the host cell is a natural or non-natural host for K or 812 bacteriophage.

14. The bacterial host cell of claim 12, wherein the host cell is a natural or non-natural host for K or 812 bacteriophage.

15. A kit comprising one or more coded/labeled vials that contain the recombinant bacteriophage of claim 8, instructions for use, and optionally at least one antibiotic.

16. A method for identifying at least one bacterial strain or species in a test sample obtained from a subject comprising
    (a) contacting the test sample comprising bacterial cells with the recombinant bacteriophage of claim 8; and
    (b) detecting the expression of the reporter protein of the recombinant bacteriophage, wherein detection of the reporter protein indicates the presence of at least one bacterial strain or species in the test sample.

17. The method of claim 16, wherein the expression of the reporter protein is measured in about 5, 10, 15, 20, 25, 30, 35, 40, 45, 50, 55, 60, 65, 70, 75, 80, 85, 90 or 120 minutes after contacting the test sample comprising bacterial cells with the recombinant bacteriophage.

18. A method for determining the antibiotic susceptibility of a bacterial strain or species in a test sample obtained from a subject comprising
    (a) infecting a plurality of test samples comprising bacterial cells with the recombinant bacteriophage of claim 8 and an antibiotic, wherein the plurality of test samples is derived from the subject;
    (b) detecting the expression of the reporter protein of the recombinant bacteriophage in the plurality of test samples; and
    (c) determining that the antibiotic is effective in inhibiting the bacterial strain or species in a test sample when the reporter protein expression levels of the recombinant phage infected bacterial cells in the test sample are reduced relative to that observed in an untreated control sample comprising bacterial cells, wherein the untreated control sample is derived from the subject.

19. The method of claim 18, wherein the antibiotic is selected from the group consisting of rifampicin, tetracycline, levofloxacin, ampicillin, penicillin G, methicillin, oxacillin, amoxicillin, cefadroxil, ceforanid, cefotaxime, ceftriaxone, doxycycline, minocycline, amikacin, gentamicin, levofloxacin, kanamycin, neomycin, streptomycin, tobramycin, azithromycin, clarithromycin, erythromycin, ciprofloxacin, lomefloxacin, norfloxacin, chloramphenicol, clindamycin, cycloserine, isoniazid, rifampin, teicoplanin, quinupristin/dalfopristin, linezolid, pristinamycin, ceftobiprole, ceftaroline, dalbavancin, daptomycin, mupirocin, oritavancin, tedizolid, telavancin, tigecycline, ceftazidime, cefepime, piperacillin, ticarcillin, virginiamycin, netilmicin, paromomycin, spectinomycin, geldanamycin, herbimycin, rifaximin, loracarbef, ertapenem, doripenem, imipenem/cilastatin, meropenem, cefazolin, cefalotin, cephalexin, cefaclor, cefamandole, cefoxitin, cefprozil, cefuroxime, cefixime, cefdinir, cefditoren, cefoperazone, cefpodoxime, ceftibuten, ceftizoxime, lincomycin, dirithromycin, roxithromycin, troleandomycin, telithromycin, spiramycin, aztreonam, furazolidone, nitrofurantoin, posizolid, radezolid, torezolid, azlocillin, carbenicillin, cloxacillin, dicloxacillin, flucloxacillin, mezlocillin, nafcillin, penicillin V, temocillin, bacitracin, colistin, polymyxin B, enoxacin, gatifloxacin, gemifloxacin, moxifloxacin, nalidixic acid, ofloxacin, trovafloxacin, grepafloxacin, sparfloxacin, temafloxacin, mafenide, sulfacetamide, sulfadiazine, silver sulfadiazine, sulfadimethoxine, sulfamethizole, sulfamethoxazole, sulfanilimide, sulfasalazine, sulfisoxazole, trimethoprim-sulfamethoxazole (Co-trimoxazole) (TMP-SMX), sulfonamidochrysoidine, demeclocycline, oxytetracycline, clofazimine, dapsone, capreomycin, ethambutol, ethionamide, pyrazinamide, rifabutin, rifapentine, arsphenamine, fosfomycin, fusidic acid, metronidazole, platensimycin, thiamphenicol, tinidazole, trimethoprim(Bs) and vancomycin.

20. The method of claim 18, wherein the expression of the reporter protein is measured in about 5, 10, 15, 20, 25, 30, 35, 40, 45, 50, 55, 60, 65, 70, 75, 80, 85, 90, or 120 minutes after infecting the plurality of test samples comprising bacterial cells with the recombinant bacteriophage.

21. The method of claim 18, wherein the test sample is blood, sputum, mucus, lavage, saliva, or a swab obtained from the subject.

22. The method of claim 21, wherein the subject is human.

23. A method for making a recombinant K or 812 bacteriophage of claim 8 in a bacterial host cell comprising
    recombining in vivo a first K or 812 bacteriophage genome with the heterologous nucleic acid sequence in the presence of a recombination system under conditions to produce the recombinant bacteriophage genome,
    wherein the bacterial host cell is infected with the first K or 812 bacteriophage genome.

24. The method of claim 23, wherein the recombination system is endogenous to the bacterial host cell.

* * * * *